United States Patent 10,233,495 (METHODS AND COMPOSITIONS FOR SCREENING AND TREATING DEVELOPMENTAL DISORDERS) - sequence listing, part 181

SEQ ID NO: 1154 - DNA, 112280 bp, Homo sapiens
tacacaatataaatgctttattgctagcacagaggtttctttttaagtaaattaaaagaaataaatcttcattttcacattttttgttgcagtccaaaggtaactagttggttagtggctatgtccacttggacacatgctacaggagggcagcattcacatggaagcactcagaaatacggcatctgtcagggctcacggcactgggctgctgaatgcactgtcgtttgtaaataacagcaagtggagactttaaaacatcatggatagataagagttataaatagaaaactggtacggttaagaagcagaagatcgttaaatacagaaggctatatatatgttgcccatattccacatactctgggttatgtttggtacttttaaataaatgatctgcatttaggttagagactggattggatttgacagctggaaagatggaagaagggatggaagaaggaaaggaagctaacacttcccacatcaaactggtggagtcactggaaagcagaagaggagtatgtggatgggaagaaagggaggcgggcctgctttactccctgcaagctgtaggccatggcctgcccagtgaggggcaagaatggggtgtgacagaggagctcagtggagcacggcagtcctggcacaatggaacttggcaaatggaaaaggaaacccctaggcttggccagattttccaaggtcactgccaatagatacagggcacattatgatagatgtacagtgtgacagaccaaaatcacacctgcagcagttattggtgtagaggttcagaaggtacagattccaactacagaaataattcatttaataataattgttgcccaatattagaaactgaatgatgtctgcaaggcatccagcattatcaaattcttgggcctactcggattgttttttggttggttctaagaaaaactttggaaaagatcttatctagctatgaaaaacaacccactccttgccttattccagaataactgagaaggaatctaatacacacacaccccaaaactgcagcaagctcagaagcggtgaactgcacatgatgacttccagtctctattgtcccaatcttttttcattcatgttatttatgggtaaaagaaaaccagattgggtcaggaatatcccaggttcttactacatctgtagtgtaccagctcctggcattttcattctggtctgactctagctaaaaccatttcatgttttgctttgaagaaatggataacatgaaatgataatttggctttacaaccttgaaaaattgttcccggcccaaacatctgccccagaatgagctcagctgacatctccttggaagagagggaggggtgggtgagcgaggagggcctggaaggaggaaaatgaagacaggagaaaggtcacctttccttgagaggaaagttctttgtgacaaagacatgaaataatacagctcccttatttcatcctgtgctccagaaggagatactggatgtgtctgctagctcctcctcctccctttatcccactttccccaatatttggtatgattaaggtggccccttacagagtgccaagaaactgtacccagctggtttgctttagttgtgcagtgacctgcctggcctacatgttatcttttcaatctttaagtaaggaccgtggctcaactttgtattcctgagagctgggccctacagagaaagcagagagggacagacgtgcaggctgggcttcatcctccttcttggccttcttaggagttcttctgggggatctttactgtcaccgtcttaacttctgagtactcccgcaagccaaattctcccctgaaacacagaaatgggccgggtcagataccagaagtccagggagctgcatgtgagtgcagcgggagtcctggggaggtgcagtttatcacctgcgaacagcaagtcctgggatgttcatgtaaaaattcctcacgtatgcgcagcccagccttcctctgagggtcagagaaactgtcatctcatgagtagtttttaaagaagtttttttaaaactttaaagttttttaaagtagttttaaagttaaaaggtgacttgttttcacaatactgcacagacaggcaatgactctcaattactcagagaactaccatcagccttggccagagggcacacagatgaccccaggctgtgctcagaggctgagtgctgtgggcagcggtgggaccaggcccaggtctctgaacgccttggccatgcctctctccacaaggcagcactggttcagtattagttctttgggacagtagtgtgctttcctcccccaagacggagggtgggagtgggttgcatgtctaagtgttcctgtccttctgcgtgtttactacagtgctccttctcctccacatctcttctctattctcctgttctttttgccttgtttaaatgccttttttccccttatctaatctatttcattataaaatcacgcatgttctcctctttttcttctcttcttctgaaagtcactcttcagtgatgcttttcccaacagcctcaggaggagctcctctttcgtcctctctgttcacagagccccttgttcacacctcaaccaccacacttatcacactgggaggacaaggggcttgaatatctctgtcttccctactgagttgtatcctactgatttttctttttgccttccaccaaacatagggtatagcctacaacagcaggcacaaagaaggtacctgatgaccaaggaaggaaggaaagtagagaggggaggagggaaggaggaagggcgagcttcctattccctcttcccaagttctaccctgttgtcatatcttctagatcaggaaaaaataaaaacaattaggagatatatttgaatatgaaacaattaaatgattaagaaaggctgtcttttgaaacagtcagtgtacgagttactgtggctgggctttacaagagagacctgctgtaaatgattcattcaggttccttttaggagcccccatggcctacataaggctccaggggctttgccagcacctcctctgagcaccgtgggcacctgagttgacagggacaacagagggcggccaaggagagactggggcaagcaggctgttctcctgtccgtatagttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgtaaggaagtctacagcatcagaaacctcacaattatggttgctttcaagtgtgactgttggatcctaccgtttgggtgtgtgatgcaatggaaaaccctgctggagcagagctgctcctctctgggtcctgagcagtgatctgtgcacgggggaagtggactcaaatctgctaccaaaagaactgctctgtgcccaggacatgaaggaaagccagtaagcagtcttagagcagcacgactgaggaggcatggaggagataaagagcactgaagctggggtcagagacaggagtgcccactcagctctgccatgaaccagctaagggatgccagctgagtcactgtcatcctcttggtgcccagtcatctctccagcagttcctgaacctcagtatacataagtatcacccaaagagcttggttcaacttttgattcttgaacgctacccccaccccacaaagattcagtttcagaagctctacggagggaccaggagactgagagacagatggtcatgtgggtcacactttgggaaacatgctcagaggtcattgagccctgaagtctcgattcttaagcaatttcaccatcttgttccaggatttctgtcgcatatttatttactccagctaaattttgtggcacatacagttaacagggaagaagctcactgatgcacgaaaggtatgcatatcattactgatgcagcccaatctctctgtgtggttaccttcacatcaggacgaaacagcaaggcaaaatcacatttagaagactaggttctagtccctaagataaatcaaacttggcacacctagaggctttaaggtaacctgtcagtcagtattggtagctcttcgccagccattttaggactcactcagacttgctcataaaacaagtaagagtttctgtttagggtatatattttcctgctcttttacttgacttgcagcagcatttttcagagcggagtaaagtctccagaccatcagcatcagaggagcttgcaggtggtcaggactgagagggtgggtgggagcgggtcaccggaaggcaggttgctttcaagggtgactggtggatcccagtgtttgggtgtgtgatgcaatgtaaaaccctgctggaacggaggtgcttctctgtgggtcctgggcagtgatgtatactggagtcactctggaagcttgttaaaaacgcagttcctgggtcctatcgcagatcaactaactcagaatctctgagagtgggtccctagatacgcatgcttaacaaaaccatcacccagactggaggtgacttctctgtatgcatgcgtgtacacgcacgcacacacacacataaatttgacaagctctgatttagagtatctaacaatgcttctcattttcaaagccagtgtcctgagtttttaaaatgctgaggttcacagaattctttccatctcctcagtttgtgacattttatggcttgtgctttgccacccctcatctcaggggagtttgataaggaagtaagaaaaaggacaggaaaagtgaaacaggcagaaataggtgggcaggaggacctgagaaaagctcgtctctgagcctgggaattaagagggcagccctccccacagctctctgtggggagacctcgtgggctaggtcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaaacatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcgatcatttattgaaagtatattttatgctcatgattcaccctgttaatgatctgtaacaaaacaatcaatgcaagcagcattcccagagccagtgactgaccccagcatttcagagactgggagagcacagacatagaggaaggaaatgaaataagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagatattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctgtagcagatcatatctaaaggtttcccagatttttccagttcacagtgatcttccctatccctgagctcctccattggtttacagtcttttctgcgattcctctgattctttcaatgttattagttttatttaccccaaaacatattaaatgccttaaggacctgcatcttcctccatagaccaagcacagtgctttgtacatatttatgctcaatatttgttagattgtgaactaggcatttgctcaaaaaaataggcattcagtaatggctgagggaacgggcatgaaacatgtttcctctgtgagtcacagcatttggcaaatacagatcagtttctttcaaaaggagggaaagtgggttcttttcctggatgttacttccaggaaaaacggttacttcctttgtgaagtcttctaggacccgagcagtcaaaattaattgatttttctctgtactgacaaaatgtttaacatacttctaatcatagcctttactacagggaattaatggtacattaattttttccattctcactttgggaaatggaattgtgttttattcatctctataacatgtaatagaacttagcttatagtagcatgtgctccacgaaatgtttgttgaatgtatggatgagtgtaagataattaaactattttttaagtactgctctgtgctgatatttgcaatctatttctctgcaggcatcagcaactttaagacttacatttctctcccatttccagacatcttgaatcccccaaaggggctctgggcatttaaggcattgtaacaattgatcctgaaagaagaaaacatagcactgtgagttcgtgtgaagtctgagcacataatctgactggcatggtatttcttttagaagttttatttttaaattcctttcctccagaggaaaaaattgtaatttaaaatctactttgatttctggatctaagcagtaaggagtgtaccccttttctggtgaactttggttgcttttggtattccccatccttccaaggagatacttgtttatttcaccctggtccctataccaccagtggaatttgttacaagactgactctgatcttaccaaacagtcccagcttgcattgcagaagacactgtgagggccttgttgatgtcattagtaaagacagctgctacgagtccaaagtctgagttattggctctttcgataacttcatccatcgtcttaaatctcaaaatttcctgaacagggccaaagatctgcaaaaagataatatgactcaacatggttgctctgtcattcctttacctgctttccacatttcaatgcaagtttactctgccttgattacttaaatgacctttaagtttagcagtacaaaactgtaaaatctcccaacctttcctaggataagattatgcaagaagagtctgacattagtgtttaacctccccaacttccccaacctctccagcatcacttgattccactgtgtatactaggggtgtcttctttaggtacagaagagcaagtggcatcctccgtgatcctgcaaacactgctccagaacggaatgctctggactgtgggctgatttgctccttgtccctctcttgcacagatgtaaagatgcttcagtggattctctctcctggttaacatcccagtgacccacatttaggagagccgaactattgccagtgtattgttgaggccaatggcaggctattctgattgttctgttggctaataataatcataagcacatagcatgtcacctggcctccacctagcttgcttgtcttttggtttatttttcttcttgaaactggaattttcatagccatgttcattactgttgcaaaatgaatatatgtaaaatataaagagctaaaactctaatatcatccactagaaatgctctagaaatgatcccaagaaagatgtggcttttgtaagaacagcatatttgatacctcctccttggcaatccgcatatcatcagtgacgttggaaaacactgtgggctcaatgaaaaacccctttcggcccagtcctttgcctccacattccagcttggcgccctcagccacaccactctggatgagttccaagatcttgttgtactgtttcttatcaatctgtgggagacaagacttaatgactccaaatataaccttctatgaaaatggaaataagtatgttcttgagaatctttcattttagggtttttttcaaagtttaactacacccagtcagatcatataaaactgctgttacttaccaatttttgacctacaaaaaactggcaattttgtatggttaatcctaatatatcgacgattccaataaatgtactgctctgatgatattgcctaatcagaagtaccagctgaacatttagaaaaatgtttcaaaatgatggagacactggctaatttactattcaatgttcatatgagggaaaattgacttttataattaaatgagtaacttagcaagttgtattgatagtaaaaagaggcaaaaattagcacacagcctttttagatagtgctacatacccaatcttattgtggtttgtttttaaaggaattcctattacacttttagaggaactttagaggaaaatattaacagtaaagagtgaaggatgagcttcctagtccaaaaaaaaacaaggtcagtcttcccccaaaaaactgacggagttatcatttgcttattatggtaaataacacaaaaacctacatttacccaagtttgaatggctcagccagaacatcaatcttctcttgaataatccctaaacccatgctttagtgacccatataagagctggtccaggttccttctgaaaattctcagaacctgtctacagattaaaaccagaattccctttagaaatatgcctcgatgattacggtgaacctgcagaggaggctgttcaggagagactttgtggccctccccaccccactaaagtacacgaggccttcagattaagaaataaccatacagcaaaagggaagtgagccagcccttcacttcctacactttcacaagctacaagggatctgtccagactggttcaggctgctggagagactccttggcagctcgtaaaaggatagatggctctaggaaagaaagatatctaccctccttgactgtggcatctgtagggatgtcctaaagttcagtgattggaaggactgggactgggttctagtgtccagacccatcttgtcatactcatggctttctttagaactgagagactccagcttagtcccaaaggtcagaatattcttttttttttttttttgagacggagtcttgctctttcgcccaggctggtggagtgcagtggcacagtctgtaagctccatctcccgggttcacgccattctcctacctcagcctcccgagtagctgggattacaggtacccgccacctcgcccggctaattttttttttgtatttttagtagagacagggtttcaccatattagccaggatggtctcgatctcctgacctcatgatccgcccgcctcggcctccctaaaagctgagattacaggcgtgagccactgcgcccggccagaatattcttaaagtaatggtaatcccatagtttttcagagataaaacttagaaagggacagagaagcataagaaataagcaatccctctctggctccatttccagccacgaagacatggtggagaataaaggagtcagccgaaaaggaagatgtcgctttgctgggacctactacagtgtacacagttctgtgccagtcaaggattaagtaaacaaagggaatggttatgatttttctacctggggaccctgctcagtggtggggtcaaagggactccccactacgcgcctcttggcccgctccacgcttcttctcacaaactcctcatagatggactcctccacgaagatgcgagagcctgcagtgcagcactgaccttgattgaagaacacaccctggtgggcctgctccacagcatagtccactacaagaggaaacagccatgttctcaccgctttgcctggggaggggcctgtctatgaagccgcctccctcccctctccaaagccctaggtatagtgtgctcactgcatgacataaccatgaatagccctggattgggaatgcaactagttctaactacaccctgacatgctatgtgaacttgaacaacttcacttctttgggtctctttcttattctgcaaacagaggtactgaacctcgtgtataacaggagtctcaaacccctatataccacagggcttgggagataaggtacaggtatgagtctgccaggtggtaaagcaatgtaatggaggggctaagaaggaaagccactacatttaatcattgccatgcataaatatgagccccaggttgccagatcctctcaattttcacagaaatcaatattttaatgtgcagttcttgttttgaacatagtgtaatgtttagacaggtaaacatgtctatattttgtatttggccaatttacaactcctaaatctacagggccttggggctgtatgtttggtacttgggggattaaaccgtaacaccaatgggtcttctttgaagacactaaatttcctctagattgacatggacttgtgtaaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggtgctgaaattcaagcaatctgcttttggttttctgatctctctggtggtgagactgggaaagcagctctgcctggcaacaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgtgtgctgtcatcctaactgaaagtcatgcgagcaacagaaaggggctggaattgactaaacagagaaggggctgtgggtttggaaaatgctggcagggctggtcaagtcggatttatttaaaatggtctaccagccaccaggcacagttgaaaagttacagatttattgaatctaggcagagagactatccttcaggtgctcagcagctgagaccactgctgttgaaccatatgccactgaccaagccttcatctcatccccctattctacaacatcacagattcaaaatggctcattagtgtctagaaaacaactggttcagtcgtcaactgaaaagtgctctttccccattattaaaccattttctccttagaggagatctttttgattgcccttagcttcaaatatcttttgctagtgtcccatcaaaagtggagatataaaagagagcaccaaagggtgtgtggtggttcatgtatgggacctgtagttgacttacagtcagcatcagcaaaaataatattaggacttttgcctccaagttccagagttactctcttcaaattacttcttccagctgcttcttggataagctttccaacctgaaagaagggaaatggagacaggttttgcaaatcctgcaggtgagacagtcaccggccaatgccagctcagggcatcaatgggatgcaacagtaacaaaccctaaaaggcaagccaacccagctcttgtcatcagcttgggttacaagatgtaagttagtggggtacagtttaatgtccatgctggagtgaactggaagacagctttagtttcgtgatggaaggactaaggaaaagggagttaaatctggaatcttaatcactgaaagatttctctaaagacaactggcaagaaaaatgtaactggagatttcaatcactgcattgtggcctttagctttggactccggctccagaaaaaagccaactggtgccacttgaaagatatcatgaggataaaacaaattgttcatgtatctcctaaaatgccaggcatgctttttattacatgctccaaagagactatcaatattacacctttgcctctgcctagagctacagtaaaaggataccagacagttgagaatctctctttttgtgcaatcttgtaaatgccgtttatcttgaatccaagtaaacaagaggctgagttaggagaaagcacttgccaatgagtagactcacattggcaatgaaaatgaaagtgtcataatggaagcaaagatccaccacttagagcccctgctcaaggcagaactctacctcagtgatggggaatgctgttgggagacagcctgcagctgtcacctccttcagggtccacctcagctgaaaagagctcccttgcccaaggagaagccctcttccaagtggcccatatccacccactggtggtggcagggtttgtataaaggtcctaccctttcagcccagcacaggactgggctctgagggacggtatatactccatgatgacccaagtgactggcagaggctgtgtcaggcctgtgttgcagttccacttccccagggccactccccttcagcagggatccctagtaaaatcctgcaagctaaactccaactccgtgaatgctccctgggaacctaacctacaacaggatgcgactccactggagagcacatatcactttatggaaaatgcagagcagagccgccatatagtccatagaggcaatttggtcttgttgagatgaaaaaatgttatttgttcctgaaattttcctgaaaattaaatattttaaaagcgggggaagagaaacgctacattcactttcaactcctgcagtcccttgttgagatcctccagtgggactaacgacttcgcaggcagcggagaaccccagctaggagaaaaggctctggagccagactgcctggattttttttttttttttttaaccagttctgtcacttcgtaactgtttgagcctaggaaatttatttactatctgagccttggatcctcctctgtagggggggataaaaatactatgtacttcagaattatattttgaggattaagtggtgtaccatatatgacacttagaacccagcctggcacacagtaagtgtgcagacatgctaaccatgagcaagtgtgagaagctggggcctcccttttcttccacgttcaatggacagaaatgggggtgatgtaaaggagacagctggaccttccaaagcaggtctcccgtagatctcccaaactgcctgtgctgttaactccttcagaaaaacaccggggaaactccaacttcccctcagtctccaatatcactcattaactgtaactctgcctcctcctaaaaaagattttgaaaatgtatccccatcctgagaaaagctaaccttagggggaaaaagtgatgtctctcaaagatgcagaactagagtttcttgatttgctgaaaacatgacttaccaaggtgttggaaaatgctaacacctggccctgaagtttgatgggtgagctgtggccaacctgccagactgcccttcccccgcccttgccattttgtgtctcttccacttccacgcaaaggcctcaggaagacctggtctcagtaaaggccctgttctcacacagacatggtcctctgagaagaaaacaggcaaacacaaagggaaggagaatctggccctctcttctgggaatgctgaaaattatgactggtaagggggaactcacaccgaagggcaactggggaaacagcaatcctctgacttactgccagcactcagggaggggtgttccctgaggatgctgtcatctgtgactgtctgctcttctgagaatgtcattgtgcttgctcgctccactctgggggaatccaaattaactgatgtggactcattttaaagtcaaggaagataaacaggtaactgctttctcaacaagacaattactggaattcacaaacatattattcattaaattaaaccagtatttattgagtagtctatgttagatacttacaagcattatgtcatttaagcctctcaaaaaaccctacacagtaggttttatctcattttagagatgagctaaatgagttagaagttagtgaatgtcaccaggctccccagctggttcatgacagaacctgttggactatctgcaggctgatgccagagcccaggcctgggattactccctctccttctcccttccttcctcccagcattctgtcatttttctgttctcttttctacatttactgagcactaatgtgtgccacataccatcaaaatcttatccctgcactccaagctgatttcaaagtaggtaggaatatcacctcttctagacaaaaataatgttcataaatcatcagttacaaaacttagattctgccttcaggattatattcaagaaacaagcaaaagccaggaaaaatcatgagttttacacatagtaagatgctgagtaaatatttggggttggcagacactgctggcccagctggcattacatttctgttagccctactccctgatattcatcagaccattctagaggttgatatttttttgccactagaaatgtcggccagtgattattttcatggctatggtaactatacaaaagtaaaagtttcagtctatgatcatcagagaagaatacctaagaataattttccttgcatcaatgctttaccagcctttccttagaaaacaaatttgtgcgctgcacccactaactcggtaaacaccacaaggcaaatctcagatgaatgatacctttccccttcatctttggaagaaagtcgagttatagttcaagaaagaacgggatgtgttaggctatgggagaaccacttccatctggagtggcctcaggacaggacactcctaaacagccctggttttcaccaatgtccttcattcaacacatattcatagttctcctactatgtgccaggtacactgttgggcatagtcccttaccaataaggaattcacagctaaaaggactcccatgtaaacctagtagatgttcaataaatgtggctttgcagtccactagaaaaaaaaatctgggtctcatttaatattagatctgaacagattaaattacagttcctcagtactttgttataacccacaggtttccgaagtcaaagcctgtgggattagaaagtataagaatgaacgaattacgcatacaacaaaggcctaggattgaccaatctttctaaaatggaaaagtttaagtgtggttcctcagggatactgtccctcctgacatgaccagaaggtgggagtgcacggcaagataaaggaggctgcaagggtgcacacgttttccaagtggttaaaagtcaagttaatagagctgtacttgatgataccaagtcctattctgatgaaattggtaatttgtaagataaaacaggtaaacatacagtttgagaaattaaatcctgtatatgatgtaatatagattaaataggataaaggcacagagatcaaatttttagttcgccatcaccttttcttccaagcagaaaagattttacaacgtactcgtgtgatacctcctgccccattgctgacaacctggctaattataaccatatttaggcttatggacgacagtttggcccacaggagtcagaagacctggtactacaaactctggcttctaatgaatcttcaatttgggaaagccacttctcctcctgggtctcagcttctgcatctgtagaatgaaggcacaggccaagcaacaaatctctcccttagtactccagttaattgaaggagttaaaaaagacagacaggactcctggggaccctgctcattctgagagtctgttcacaattcttgtgtttttcttgccttatgaagcagaagtagcttgttacaagtagaacaccacagctgcactgaatgatggaaaaacctcatctttttttagtttccctgcccagagctccttatgaaagagtaagtgatagtgttcctatcatgcagttccttaactttgcactccctgcagagcctctcagctctgtgtaccccaaacatgcaagggcagtgaactgggggctcctccacacataatgaaactgggctaattctcagcaggaatgctggcacagttcaactctgactcccatcctcgtttgaataggcctcaagattgatatcaggagtatccctggaagagccacagtgtactggaatcatgttcacagcaatgcggcaatgtaggggaaagcaatttggggctttgcaagaaaaataatttgttatacaggacaaaaaggaacacaaaaggcttttcatgccctctttattcagggcagttgctccctgaacacagtttctaaagttgggtaaaatttttttttattaattactcaggtgagttcctactcagagctattttattacacatatcaaggtagatttttctcagcgatataacacctttttaaaaatggaaaaatctctactagagatcccagtaaactagttaaagatgcctgtgtcttgtaatatcttttcataaatcccaaacagatttactctctgcttcttccctcttctcctttcttaattttcattgttatgcttcctggttccaactgtgttgggaatagaaatgccaaaaatatggggattgggtgtttgtctttctgaagtacccagaaataacaggccaaattaatctgtccagatttgcaccagaaacaaacaggaccaaggcatctaagcagttcctttaagtggtaacagcagtttaaacctttatctgtgaaattcagattatgaaggccagtataaccactatgtttccagccttctgtcccaccattcccaccaccactcacccacgactctaggcacacaaaaccacttgccctttctggaacatgcctgtgtgtctttgcataagctgctccatctacctgcagtgccttttcaccccttgcttacttgataaactcatttttacagagataactctttcacctcctctgagaaggtagctttccttccctaccctccctacagggtttggtgttccttctctgatctcacagtgctatgtacgtaactctcacattgtgcttgtttaatagctgtctccccgactacaatgactgacttttaaaaaaatatgcatatgtacacagattttaagacagggtctcactctcttgccaaggttgaactgtagtagtatgattatggctcactgcatccttgaaattctgagttcaagcaatcctcccaactcagcctgagtagctgggactacaggcacttgccatcatgcctggctaattaaaaaaaaaaattggtacagacagggtctcactatgttgaccaggtggtctcaaactcttggcctcaaggggtcctcctgcctaggccttgaaagcactgggatgacaggcctgagccaccagggcccagacaaactttcaataatttgttaagtcaataagccagaatacgaaaattgcttgagagcagtggtgtgatcacggctcactgcatccttcaactccttggcccaagcaatcccgccattcagccccttgaataactggggctacaggtgcacactaccaagcctggctaatttattttttatttttttttgcaaagactggggcttgccatcttgcccaggctggttttgaactcctgggctcacacgatcttctggtcttgatctcccaaagtgctagaattatgggcgtgagccatcgtgtccagctaatgttattgttgattgagcacctattctgtctacttgttttcacaaacattattttatttaatcttcatgacaaaactgggaggcaggaattattattctattttataattggaaaaaaagacaagacaagactcacagaggtcaagaaatgacttgcaaacaggcacccactgagtggcagagccaggactggtctcagaatgtgcacaccaagcctcaggctcttctccctcctcttctccagaccttctcctgggaattggttcccctttgctgtgagtagcattttgacagttaaatgcatcatctaccactaacatgttcaactgccttgtacacttagccatccttttgttacataagactctatttcaggtaagctttaaaaatcaaggttttgattgtcttggtctgctttgataggaaaaagcatggagtagtcaagccaaaagtactctatgtcccattaactaggtgagctaaagggatcaacaccttaggacctgctcaaactcagcctgagttttggggagaaagctaactgcagaatctttgacttagcatagttagagaataaatcatggaatctcatccagcaggcagagactataccatacttattcttcagtcttcaagttttaagaattttttaaaaagagaagttttatgctaatagtttaaaacctacacaaccaaaggtttttccacatgaaactggttttttcaatattttcatgacattcaaactggtatttttaaataaaatactgaatgattcacgaatggactcacacaaccttagaaaaaggcctattagctgtttatagctaaaactgtagcaagccacctcccctaacctaaaatgaggggtgaagctaactaggagagagctgacctgattcatgactcaagcagtagagatggtgcttgtatcatgcaacatgacatttatctcacttaggaaataaaagaaccccagctgcgtaaattagaatgagtgataatacagctgttagctacaaacatttgtttggcacgaatcaatctggactctgctgtagtttgctttgatggtctctccactatcttgctgctaatgatgagatcattgtttgttaacctgagtaaagaaaacactataccaagcaaaatgcatattgttttcctgtactttattgaagttgtttattgacttgtgtttataagagctcttttatatttattaaatatttacatgcactgcttatgtatttagctgcataaggagaaattaatcccatctttaatctgagtaaagttgttggctttctaaaggccttttgctttagtaaaatggaaagcagccacctcaaataagcttcttcttgttaactgttccagacactttgtaatgtaccaataggtcccatctccctaaggtaatcacagcagaagccatgttctaatccatatttaagtgacatgttcactctggaagaatctatacaacttctcaggtagcctgcaaagttagaataaatggataaagaagtaaataactacagctgaaaaggggtttggggattatgtgatcgtttgatttgcctgtgaaaattctccatccaccactactaatatggaaattacaaattggcttttatattctagacaaatgccgctctcccttaagtcctttagtgtctgccaataatgtcattccagagaagaaactaagagataacctagaagtcacgggattagttcccctccaaatgaatgtaagcctctctacagagagagaagaatcaaatgtagattctgttagaaagtttagctgaaaacttgctctattcacactgtaataggctacttaatattttaactattcctaaaagcaaaacaattcaaagacccaccttccaccctattctctttcccaaattctcccttctctctctctctctcagttccctattgaatatctcagtattggaagattgcataggtagttgttaatgttttatttgtgaagataaaaaaattcctgttgttataaagctataatagtcaaaataatgtgatacttgcgatgcaacagtcacacagattactgaaacagaacagagagtacagaaatagacccatatagggccgggcgcagtggctcatgcctgtaactttgggaggccaaggctggtggatcacgtggtcaggagatcaagaccatcctggctaacatggtgaaaccccatctctactaaaaatacaaaacattagctgggcaaggtggcgggcgcctgtagttccagctacttgggaggctgaggcaggagaatggcataaacccgggaggcagagcttgcagtgagccaagatcgcgccactgcactccagcctgggtgacagagcgagactccatctcaaaaaaaaaaaaaaaaaaaaagaaagaaatagacccatataaatatggaaaatttatgcttgaaaaaagcaagcatcacaaaggcaattcagtggaggcagggtagtcttttcaagaaatggtgcaggaactattgtcattatccatctatctagcacttggatccttacctctcaacatacacaaaagttgaagtagatcataggcctaaatgtaaaacacaaaactataaaatttctagaaaaaaagcatatgagaaagtctttgtgatcttatgttaggcaaagatttcttagataccataccaaaagcctgatctataaaagaaaatgttaataaactggacatcaaaattaaaaactttaagagacactgggagaaattatttgcaaagcacaaaggacttttatccagaatatactaacaattttcataattcaacaatgaggaaaacaaacaacgcttgtctccaaagtgtgcaaagatttaaagatacttcaccagagaagatatgctgtggcaaatacacaaatgaaaagacactcaatggtagagaattggaaattaaaaccacattgagacaatgctatatacctatttgaatggctaaaatgtaaaagactaaccacatcaaatgttggtggggatgtaaaggagttcaaagtcttaaacattgctggtaggaatgtaagatggtataaccgatttggaaaacagtttggcagtttcctgccctaccacacaatccagccattccattcctaggtatttacctaagagaaaaggacatacatgtccatacaaatatttgtacatgaatgttcatagaagcttttattagtcccaaactgaaaacaatccaaatgttcatcagtggctgaatggataaacaaacatacaacaaatggataaatccaaatgttcatcattggctgaatggctattaaacctgatacaggttgaacatcccttatcaaaatgtgtagaaccagaagtgttttggatttgggatattttttcagattttggaatatttgcattatacttaccagttgagcaccccgatctggaaatccaaaatccaaaatgctccaatgagcctttcctttgagcatgatgttggtgctcaaaatgtttcaagttttgggggcattccagatttcagattttttgaattcagaatagttaaactatatacccataaatggactactacttggcaataaaaaagaacgaattgatatgcacgacatagacagatctcaaaataactgtgctgagtaaaaacagctagacaaaagagtatatactatatgttgccatttatataaaattctagaaaatgcagataatctatagtgccagaaagcctgggaatgtgggggtgggggtggagagagagataagacagagagattacaaaggggcactaggaaacatgtgagggtgagggacatattcattgtgaactctactgatggtttcacaggtagatggatacacatggccaagacttatcaaattgtacactttaaataagtgaaatctattgtatatcaattatactacaataaagctgttaataaaggtacattaaacaaaaatattacttcattacagaaattatgccatatatctctttgttgtcctttgcagactactggcagtagttggtctttgcacaactactgaaaaacaaaggaaactacgtaacatttttctgcaaagaaatttctccctacaccagaattccattctggcaaactcagtttgaaggagtggccaccactctaggccacagcaagaaatcatgagtgagttccttaataggtaccaggcatcttcttccagcactgtattttttaaaattatactttgaattctgggatacatgtgcagaaagtggaggttttttacatgtgccatggtggtttgctgcacccatcaacccatcatctacattagctatttctcctaatgttatccctcccctagcccgacaggccccggtgtgtgatgttcccctccctgtgtccatgcatcctcattgttcaactctcacttatgaatgagaacatatggtgtttggttttctgtttgtgttagtttgctgagaatgatggtttccagcttcatccaggtccctgtaaaggacatgaactcatccttttttatggctgcatggtattccatggtgtatatgtgccacattttctttatccagtctatcatcgatgggcatctgggttggttccaagtccttgctattgtgaatagtgctgcaataaacatacaagtgcatgtgtctttatggaagaatgacttataatcctttgggtatatacccagtaatgcgattgttgggtcaaatggtatttctagttctagatccttgaggaattgccaccatcttccacaatggttgaactaatttatactcccatcaacagtgtaaaagcattcctatttctccaaatcctctccagcatctgttgtttcctgactttttaatgatcgccattctaactggtgtgagatggtatctcactgtggttttgatttgcatttctctagtgaccagtaatgatgagctttttttcatgtttaacggccacgtcttcttttgcgaagtgtgtgttcatatcctttgcccacttttcgatgtttttttttttttcttgtaaacttgtttaagttccttgtagagtctggatattagccctttgtcagatgagtagattgcaaaaactttgtcccactctgtaggttgcctgttcactctgatgatagtttcttttgctgtgcacaagcggtttagtttaattagatcccgtttgtcaattttggccattgcctttggtgttctagtcatgaagtccttgcccatgcctatgtcctgaatggtattgcctaggtttttgtctaggatttttatggttttagttcttacgtttaagtctttaatccatctttagttaatttttgtataaggtgtaagtaaggggtccagttactgttttctggatatggctagccagttttcccaattgcttggattttgttaggtttgtcaaagatcagatggttgtagatgtatggtgttatttctgaggcctctgttctgttccattggtctatgtatatctgtgtttgtaccagtaccatgctgtttttgttactgtaaccttgtagtaaagtttgaagttgggtagcatgatgcctccagctttgttctttttgcttaggactgtcttggctatacagggtcttttttgattccatatgaaatttaaagtcgttttttctaattctatgaagaaagtcaatggtagcttgatcgggatagcattgaatttataaattactttgggcagtatggccatttttgtgataccatgagtatggaatgtttttccatttattgtgtcctctcatttccttgaggagtggtttatagttctccttgaagaggtccttccaatctcttctaagttttattcctgagtattttattctctttatagtcattgtgaatgggagttcactcatgacttggttgtttgtctattattggtgtataggaatacttgtgatttttgcaattgattgtgtatcctgagactttactcaagttgcttatcagcttaaggagattttgggctgagactatggggttttctaaatatacaatcatgtcatctgcaaacagagacaatttgacttcctctcttcctaattgaataccctttatttctttcttttgcctgattgccctgaccagaacttccaatactatgctgaataggagtggtgagagagggcatccttttcttgtgccagttttcaaagggaatgcttccagcttttgtccattcagtacgatgttgcctgtgggtttgtcttaaatagctctaattgagatatggtccatcaatacctagtttattggatttttagcatgaaggggtattgaattttattgaaggacttttctgtatctgctgagataatcatgtggtttttgtcattggttccgtttgtgatatattacatttattgatctgcatatgttgaaccagccttgcatagcagggataaagccgactggattgtggtggataagattttttttttccttacagacagaggttttattgtgtttggtccacagtcatatttcacattatctcatggagcagggcccctgggtggggggtccctgtgcagtacttggaggggcatgtggccgggggagatggagcagtatagctggtcaggcccagaaggggagaagggctggggctccttaagacctactaaggggccgggcacggtggctcacgcctgtaatctcagcacttagggaggccaaggtgcgtggattacctgaggccaggagtttgagaccagcctggctaacatggtgaaacctcgtctctactaaaaatacaaaagtagccaagcatggtggcacatgtctgtaatcccagatacttggggggctgaggcaggagaatcccttgagctcaggaggtggaggtgcagtgagccaagatcatgccactgcactccagactgggcaacaactactaagaaaaaaaccctactgaggccacggtggtggtgtggggagttggggggattaggcccaaccactcagcatccacttccttgtacaggcctcactttccccactgggccctgaggcaggtctgaggtctgttggcctgagggtcctagggaaatccagccacttgggagcctgagatatttagcatcatagacaggccccctttcccaggggactcatttcccagcaccctctccactgtccccaccccattcctcaggaaaaaaaaatgtatttttcttttgttaatgcatcctgaaacttttgcgggtatagaaaccacaaactgatcggctgacaaaagtgggaagaggcaaggcaactggaaacctccgggtactggttccctccaagcccaggtctcttctccccggcacagctctgctggcagcctggacgtgccagcagggaccctcaccatacacatattgggatatggccttgaccccttctcctccacagcctggtggctcattcctgcgaaggaccaaggcaagggggaagaaagccctgctgcctgattccacgttgccactcacagaccctcggttgattggcagcactgaacaggttaagaaaaaaaagatgaaaacacagaaaaacccaaaaacccagaaagggagataatgtggggagagagtgtgctgggagcctcagtagccagcctcctcctggtagtaagggggatattcagggacctctcctgggcccaggcagttgccagcacccaagggagccccgtcagccactgtgcctggcaggcagtacttggggtcacatatatgctggcccaggccaaagacctggctactatggttggtaccctgggtgtagcccatctgcagggacatggaggaattaccacacttgtcggttcccagcttggtgtcacagatgtgctgccgcgtcccaggagctgtcatgctcacctggctggcacagttatttgtacccatctggaggccaatgatcgagtggtccatgggggggcaggatgtgattcttggggtcacacagatgcctcttcacgccatacacggtcatgcccaactggctggtacatttgttggtgcccatttgcagcccgatgacgcactggccagccttcatggcggcgtcactgaagttctgctcctgcttctctgagtatttgatgccaatgtccaccccgctctgcggcctcttagtcttgaccttccctgctagggcaaaaagagacacctgcatgtgcctcatgttcccactctcaaacaggttgttggccttgaacaggtccatggggttcatgtcatagctgactacagccttgatgaagttggagaggttttccagctggtgccacttctgcatggagtggttgatcttggggaatgaggccggctgcagcttgttcatgagtatgcataagataatcccgtccttcaggctcttctggaagtcaggctcaatggagatgcaggtgagtcccttgatccagctgtgaagctctgcctccttctgggggtcatatttgggcaggagccagttcttgacctcggctgacagcccatactagacgcctttgttgaactgcgtggaactcatggctggcaggctgcgggatggggccacacgggacaggggtggataagctttttgatgtgctgctggattgttcatcagggatattggcctgaaattttctgtttttgttgtgtctctgccaggttttggtatcaggatgatgctggcctcataaaatgagttagggaggagtccctctttttctattgtttggaattgtttcagaaggaatggtaccacctcttctttgtacctctgatagaattcagctgtgaatccgtctggtcctgggcttttctttttggtgggtaggctattaattattgcctcaatttcagagcctattgttggtctgttcagggattcaacttcttcctggtttagtcttacagtattctctgatggtagtttgtatttctgtgggatccgtggtgataacccctttatcgtttcttattgtgtctatttgattcttttctctttttctctttattagtctggctagtggtctatcttgtttatcttttcaaaaaaccagctcctgggttcctgcactgtattctaaatctagtacactattttaccaaaaaagaaaaaggattcatcatcattttatccaagcaagcacgaaggcagtcttccaagaagtgaaatagaagagcaaacacacacacacacacacacacacacacacacacacacagacacacacaaacactgactggtagccaaaaatatttgtaaaatatttacaaaagctacaaaataaacgaaaggagagtaaagctgccagaggagagcagaatgtagttattgacaaatatattatttgcaaatggaagtttcagattcacctaatagttactgaattcttactatatgccaagcaatatgcttggaactttcaaatacattatttcaatcttcaaatgagcctgtaaggagtgattcataggccttactaatggaagaagacatgaaataacagactaaacaattcgccaaaagtcacacagcaggaaagctggaatttgatccatgatttgtggatcaaatccagtgcctcatctattataccacacttccccaagcattaattgtcccataaacttcattttaaaaataaatagaaaacaatgacagttaatatttactgacactttactaagaattagatccagtgctaaacactctagatatactagcttttcttagtccattcagtttagctataatgtcccagactggatacctaatagagaaaggaaattcatttcttacagttcgagaggctgggaagtccaaggttgagagacccacatgtggtgaacgacttcctgtggtgtcatcccatggtgaaagatggaagagcaagagacgacaagacagcacgagattcaatgtgcaatctcaagcccttttataatggcattaatctattaatgtgggttaacagattagtacccacctgaacacccctcactagtgcccatctctcaacactattgcattgtagattaaataacaaacacactctttctggggaacacattcaaatcatctttcatcctcacaatccatgaggtaggtacaatcatctctaatctacagctgggatatctgaggcctggaaagattaaataataacatgtaatgtgaatgaatccactcaagtataatagatgtttaagttgtctagttttctgatatgactgacatatttaatcttgattcctttagtatgatttgaagactatgttcaaaacttactgaaaaagtgatgatttcctttagttggtttagagagacgcaaactatagagttgtgatatactattctgtcaaactttcattttaagaaagcactgaggagtactttgttttcttttaagagactctaagtaaaggatgaagagaaattaactcaggctgaactacattaatgctgtaaaaatcctaaagtaacgttaaactttatgggttggtctttgttgataattagcttaatcagattgatcatttactgttcagcttgggaattatctttgcttatgacaagccatctgcatagttttgtagatggacattacttgccctcaatgtggttaagaataatataatctgaagtgtaaaaagatgattcatgggaaatcactgttgaggaaagcctagtattttctccagcttttacacactttggtaccccctgactattaactactctcactagaacactgaggctacatgtttagcagtcactgagcatgtcatgttcagtgttggctcacctaccaagagttaacgaccctaggaaatcagacacacactacccttctcaacatgtcccatctggtatgatttaggttcttagggatgtgttgtttgtttttattttcccatctctataaggtttttcacatcctattaaagagacttctaaggatagacactgaattcaaaaaaaatctgcagctctggtgtttaaatgactgttaaaagtacaactgcaggaatgacaacaaaactgcattcgctattgaaaggaaacagtgaaacctaatatcccatcctaccttccagcaaaatatgtatcgagcttttacaaagtgctgattctttaatatctggcataggaaatgatgttgagaataaatgataccactatttgttgattatctgccaatatcaaataacacattgtgagtccctgaggactcacgagggtcctcacagctagcattcctttcctcgaatttctttttgtattttggttcccataaaactacagttccattttctccaaagagattaatgttaagagaaaaggaagacagccttaaattcttgccagttgtgactattaacaactgtggaattaagatggagaattatctttttcttaaaatacttttatctttgaataaagtagcttttcattcaaatgtaaatatcttcaactgatgacacttctcctagatacagatacatttgaaaattatattaaatgacagaactttagttttgtccttgatcttatcatcttgaaaatcatgacatttttaggtaatgatgcagagaattctcttctctccatgctcccataacacaccacactctaatagttacatattcacagattatctcttgggctagactgaatcacataaaacaccacctttgcctctccaagatctataagtgcttgataaatgtttgtggaattgactggaaacaacttaagttttaaattttcatgtcctatatcagacagtgtcaaatggaaaccctgtattgtaacaaatggaatttaaagaggctaaagatgcaattttgaagtgaattttaggaaaaaacggagttacaatgtgtctatgacctaagcatgctgcactgagaaattatccttcctaagtacctccattaatatgtcattccgaattttaatggctctcccctatgggagggtgtatagtcccttagcctgggaggcagtgtaccactgtaatatggaatataggccctgggtgtgactctcagccctacaactaactagcatgtaaccctgggcaggtaatgtaacccctcttagccacactttgctcaatgctgtagggttgctgtaataatgtattcaaagcatttagcaggtacttgacacaaagtaagtgctaaatcaatgttggctattaatatccaaaatgtaaagcctttaatactttgtaaaattaattgatttttcacagcttgagatataactcatataccataaaatccactcttttgatgtgtacaattcagtggattttagtatattaacagagttgtgcatccatcacaaccattacttctatctgaggacataaataccccaaaaagatacttcatattccatcagcagtcactttccattctcccagtcctttgcaaccactaatcaactttctgtttatagatttgcctattctggatatttcatacagtcacatgatacagtcttttgtaactggattctttcatttggtatagtgttttcaaggctcattcaggctgcagcatgtataaatacctcactcctttttatgggtgaacagtattccattgtatggatagaccactttttgttaatccgcttatcatttaatggacatttgagttgtttccactttttggcaattaggaataatactgctgtgaacatttttgtacatgtttctgtgtggtattagattttgtcacgtttcttctgtgatgatcacctggtttttgtcctttattccattactatggagtattacattgatttttttacatatataaaaccaatcttgcattcctgggataaatcccacttggtcatggtatataatcatttttatatatttctggattttgtttgctactattttgtcgaggatttttccatctatactcataagatgttggtatatagttttcttgtgatatctttgtctgtggtatcttctacatgttggccacaattttttgacccagaattatttccaatgccttgatgtgcatattatttcccagttcatctgactcccaacgtttctccccagtcccttcccaattccgttattccactaagactttgtgttctcctgcttcgagttgttgactaacactgccctttcttcccaattcactctacttatctatatcctacagaccctcaaatccctctttctcttgaaaccttgatagaccacccaacccctagagctctctcccttcttgagatgctgatgtcatattacaaactaacatttgcttactgcttaaaatttcccaaactcatattgcatttaattcccatgaccctgagaaacaggtatgtatgctattattaaaccaattttgtacaaaaccaagtggctggtccataattatatagctatgaagtaaaaaatagtaaaccctatgcttatggtggcattttaaagcaggggagggttctactgatacctcaccttctagctctgagattaagtttttatttaccaaattcagtctttcctccttcatgtagcaacaaatatttactatgtatgtttactatacataagatactatttgaggtactgagaaggcctaagggatagactccaaagagaatgtcctccccacaaatcttcatatatgaccagaaactgccatcttttgaaagtaaaacttataaaaatcaagactaaactgataagcaaatcagctcaaagatgaaaaaggagttacttatgagagtaaagtactgcttaaatattcaatattaattaattaaatcaagggcttttccaaatccagtatgtccttatggttgtattcctaatactttggtttgaccaactgaagtaaataaaatagtaacctcattaactgtaaaggtgatctgcatgaaacctaaagaaaatcaaacaatatcaaaattaatcaaaaggtgccagagagacttctgcttctaattgtaatggagtaaccgacactggacttgttttaccattataaacaactagaaaagtatatgaaattgttttattcaaacattggatatcaggcagtatgggactatgaatctagagaaaaggaaatccttttgtgcctaaactttctagattgcagtatggtatgaggagaccaaagcagaatatgatggtctgaattctgaccagacagataagaaagatcttgttgaacactggggacattcaacagaaacctcagaaggatttcagcttattaataagaataaactagtcttaacaaagcttaaaggtaagttccaaaagagacaagctgaacctcaagtaacttaactaccttttaggaaaaaaaaagtttgacattctttaaagaaaaacaacaaaatctctaagttcagcaatataatggtcacaatgtccagtatcctttcaaaattaacagaaaagccaaaaaaaaaaaaaaaaaaaaaaggacccataaacaggaaaaactccagtcaaattcagagacgacagagaagttaaaagtaacagacaaggatttcattattatattattattattattagatggagtctcactcccgtcgcccaggctggagtgcggtggtgtgatcttggctcactgcaacctctgcctcctgggttcaaggaattctcctgcctcaacctcctgagtagctgagactacaggtgtgcaacaccacgcctggctagagatagagtttcactatgttggccgggttggtctcggattcctgacctcaggtgatccacctgcctcagcctcccagagtactaggattccaggtgtgggccaccacgcccggccacagacaaggattgtaaaatagatgtctacacaaatttaaaggaataaaggggtgtagcgaggaagaaaatataagatatttaaaaaatcatggaatttctagaacttaacaaaatctctgaagcagattaagcattacagaagaatatacgaacgtcaaagatgacaatgaaagttacctagccggaagcacaaaggaaaaaaatgctggaaataaaagagtcccagtgacccatgggataatgacaaatgacctaacatatctgtaaacagaaggcggaagtagaaagcaaaaaaaaaagatttgaaaaaataatggtcaaaatgtttcccagtttgatgaaaactataaactcacagatatacagaaattttaacgaaccaacaaaatacacaaaagtacatcacaatcaaattgctgaaaactgacaaaaagaaactctctcaaaagcagtctgggggaaaagaaacattacttaccgtaaaataaagataacaatgattgctgtatctcatcagaaacagtaaagtcagaaacatgccagaatgatatctttgaagtcttgaaagtaaaataaaacacaaactgtcacattagaattttatatccagaaaaaaaagttagttattaaaaagtgaagacaggccgggtacagtggctcatgcctgtaatcccagcactttgggaggccgaggcgggcggatcacgaggtcacgagatccagaccatcctggctaacatggtggaaccccgtctctgctaaaaataaatacaaaaaaattaaccaggcatggtagcgggtgcctgtagtcccagctactcggaaggctgaggcaggagaatggcgcaaacctgggaggcagagcttgcagtgagcctgagcaactactgcactccagcctgagcgacagtgaggctgacccctcaaaaaaaaaaaaaaaaaaaggtgaagacaaaatgaagccattttttagacaaacaaaagctgagagaagtcatcactagtagacctacgctacaagaaacgttaaagatcgttacagataaggaaaattatgccagaaggaaatgggcctacaacacaaacaaggaaggaggccaggaatagcaagtatgtgagtaaacagacaataattttgtattcttattcaaaaaacaaattttaaaacaaaaacagcagcaatgtattgtggggcatataacctatgtctaagtaaattatagggcaacaataacacaaaggatgagattggaacaatgctgctgtatggttaccacactgtatatgaagtaacataaagtatttaatggtagactgtgattgaggtgcatattgtacacactaaagcaaacactttaaaaagaggtacagctaataatgcaaaatagaataaaaagagtggtaaaattatctaactcaaccaaaagaaggcagacaaagagggaaaatatggacaaagagaaaacaaatcaaaatgggggattttagacccgaccatatcattaatacattgaatgttgaacaacaaaaatgaaaacacgaagagtagatattattccatttatatgaaattctagaataggcaaaaataattaaaaagaatcagtggttgccagaagccaagggtgttacctgcaaagaggcatgagaaatctttctaaggcatggaaacaatctacatcttgattcggatggttacacaggtgtatatacatggtacttaaatgggtgcattttattgtatgtaaattatacttcagtaaagtcatttaaaacgttaaaagatcttcagtggcaaaacagatttgaacccaagctgccttgcaataagcacttatggttttatggactcactatgtggcttcttgtctggcctgaaagaggagattccatttattcaatttaacttccactacctgatattgttatgtgccgggcgcagtggctcacacctgtaatcccagcattttgggaggctgaggctggtggatcatgaggtcaggagttcaagaccagcctagccaacatggtgaaaccccatctctacttaagataaaaaaaattagccaggcatggtggtgcgtgcctgtagtcccagctacgaatcacttgaacccgggaggcagcggtttcagggagccgagatcacgccattgcgctccagcctgggtgacagggcaagactccatctcaaaaatgttactcgtttttagactgaaatatcttggaagaaaacattaaatgctagaagttaatttatcaagaaattcctaacacctatatgatgacatcagtgatgaacattacaacaaataattgaagggatttttatcatattatatcatattcctagatgaggagtcaatatggtaaagatagcatttttcctcattttaatatggacatgtaatgttatgccaatcaaaattccaatcaaagttttttagagtaacataaggtacttagaaaatcggtttgaaatttcttctaaaagaataaatgggctttgaaaaaccaaataagagggtatgttgcctatattatagtaacacatcttataaaacctagtaattaaggcagtctggtactagtgaaagaacagaaaaaattatgagctctaaaacagaaatttcctgtatagtttggtgcaaaagtcattgcagtttttgccattaatcaaattacttttgctccaacctgtatatatggaaatgcatcatgtaatgttatattcaggcatcatgtaatgttatattcagatgagttgcaaaggggtagactgtttaataaattgttttgaagtaactaaacattcatttataaacaaacaaccctcacctttcattatacatgaaaataaattccaaccagattaaagatttaaacaacaaaaccataaaagtactgaaagaaaatattaagggccgtttgtataatcttaaaggggtttgttcaaaaatgacaggacggagcttgcagtgagccgagattgcgtcactgcagtccgcagtccagcctgggcgacagagcgagactccgtctcaaaaaaaaaaaaaaaaaaaaaatgacaggaaatccagaagctgtcagaaaaagactaaaggagaagactacatgagaatttaaaatctgcacatggcaaacaactgttttaaaaaaattaaaaagcaaagaacaaacatattttcaaattctacaacaaacaaaagattaacatacctaacctcttataaatgaaaccaatactctaaggccttcttggtaagcaagttgtaaatatgtttttattttgcaattccacttctagaaccatatccaactgagcatctaatatgtacacatatacgtgtgtgtatacgtatatacatatgtgtatacagttacagatttacaagtaaaatttttcttgggtctccaaaggtttttatttcagcagtctgtttaataggaaaaattagtggaaaaaccaccctcaagtgtacattaatacaggattaaatgatgatatactgatgcaagagtattctatgcagctgttaaaaataaatgccggagatgtaggtactaacatgacaaggtgttatctcttgtttgacatattatgctgtcatttttaatttaaaaagttacacaataggccggacaccgtggctcatgcctgtaatcctagcactttgggaggccaaggcaggtgaattacctgaggacaggagttcgagaccagcttggccaacatggcaaaacccccgtctctactaaaaatacgaaaattagccgggcatggtggtaggtgcctataatcccagctacttgggaggctgaggcaggagaatcgcttgaacctggggggcggaggttgctgtgagacaagattgtgccacttcaatccagcctgggcaaaagagtgaaactccatctcaaaaaaaaaaaaaaaaaaattacacaatagaagcctcttgactgactcaatcaggaccattggttggtcaacagaaaaaggttaaagcagaaaaagatactttaaatatttcatttctccagtcttttgatatagaaccaagaactttacttaatcatgggtccacctgtctcttctgattaaatcacacccctaaattattatttatgatttctggtttcaatttccttaaagtgaagtaaggacttaagaacatttgcaaagcaattccaggtgcccattctatctaggtttatatttttccccagtcttttacagttgtcttaaattgattgcatctttagtttttcttagcatctagcctttagcaaatattttcaaagcattaaacttcagaataattaataattccctttcatactcacattttggtttaaatatttcattaaactgcaaaattacaataacaaatacaactagaataaaatatttggaaacaaacaaggttaactcgacaaacacaaaactcagtaatctaactgaattaatattcaagtttattaataaatcttttattaaatttactactgtgagtcagtttaaccaagtataattaactctgtatcaactgataaaatgtttctagatctgtgctgtccaatacggtagcacgcatggcaatggagaacgtgaaatgtggctagtctgaagagatgtgctgtcaatgtaaaacacataccatatttcaaagaatgcatatgaaaaagaatgcaaaatattgtattaataacttatagtgattatatgttgcaatattttgaaaatactggattaaagttattaacattaatttcacgtattttttaatgtggctactagcttattttaaatgacaaatgttgctctcattctattagatagcactgttctagacctgcggacatcctttgttcaatgatgatatcatctgtgaggttctacttgaaacaatgaatcagactttcctatcatctgttacctggatcagagatatttgagtaacatttataaatcttcttaagctgacttgtgactctgtaacagggatctgtaaactatggcccatgggtcaaatataccctgctgttttggtatggcctacaagctaaaaccagtttttgcatgtttaaatgtctagaaacaataaaaagattagcatttgtaatccatacaaattatgtaaaaattccaatttccatgtctataaataaactttaattggcacatagccacactcaatattatctatgactgtttggtgatactatggcatggctgagtagttgcaacagagaccacgttgcctccaaaatttacatttactatctagccctatacagaaaaaaaatgtgctgagccctgctctatatcatctcttaaggttcatggggtatagtgagttgccaattgcacctaccggacctgtccaaacaatgagaagggaaagcttgtgtctccattcttatccttaccagagactagtttagatttccagcttcttaacttgcttctgccgctattcaacaaagtgtctagaaccccaccttctgggatagttcttacacagatggtatcacaaaaatgctcagatatctgtggggtcaaatggtccctgtgtgcctttgctttcacatccaccagtgttctatgacaccaatgttatcctttgtgggcttgggtactcactgcccttttggtgtctagcctatgggtactagttttattgtttttgtaacccctcaactcatttgcaagactgttcctcaagccctggtttttcagatacctacctcagtagaccctgtgaatgcaatcttgtctatgccaatgtgagaagctattgctgccccagccgttggcccatatcctggcaaaatattgatgaccccgggaggaaagccagcctaagaaaacagaacaggaggaaacgtggctgatgaaagctgatgcatcatgttaaatgagatatgctctagtaggctccagctgtaaggggagtcagaagcactcccgaagtccgtttctcttacctccttgatgagggctcccatgtagagtgcactgagtggtgtttgctctgctggcttaataactactgtattgccacagcacaaagctggagctattttccaggcaaacatcagcagggggaagttccactgaaaggaaaaaactcaaagttgatagatggaaaaacattcttccactactttgttttcaagctgtgacttctcatatttctcaaactagtcctcgacataaatcttgtccactacaaagtacagatgtttggattttcaattacttcattaagaatagaatagcactgaccttggaaatctctccttttctctctgaccaaccaattactatactccaactacccaccaaaagaaatcccactgtgaaaagggagttttgttacttctttgttttgttttgtcactgtttttatgttttttttaattaggctttggttccaataagttctcgtgtatgaaaacttttcttgcatctgagatttttacatcacaattttcacactggtatgaaagctcttcaacatggaaaaactagaaaattctaactgagttgtagttaagtcaatgtgtatttcaaggtagtactttttctttagatacatgcattgtcacaaacatatatgattacaaaaaataaactgcatatactgatgagtatgcaaaaattttcatttgtctcttttccactgtaaaagaagctattggagactacagtaacatttacatgagtagatgaggttggggtctaaaatggtttaaactgattttaaaaagatattaagcttgtattgtcataagctcaggcatgagcctcagtactatcaggtgtcattgataatttcattaagaaagaaaacagaaatcctcatcccctggcttcagcccttgaccacaatgtgtttctgcctgaagcatctcagctgccatccttcaaggcttctcactggctctggcaagcttgcaaaaatatacaagtgtcttgccttcaccaaacacccaatttcttttccccttagttgtttataaacttgggagtccaccgtaatgttttaattccatctacagtgtataaatcttaaagtgcagtaattgagccagagctggctgacaagcagctcttgtcctgtcagtgaagctgcagcgttgagagtctgggcaagggcaagaaaagtaagtttgaatcctacgaggaaggtgacagacctcatcccagagctggtccaagtaggatttccccagggcctttaagagcaagagaacttaaatcaaacctctcattttcccttggcattctctaataaatttcacagtaacctgggattcatcaattattcaaataaatattatatcttccccacatctttggttcccaatgccaaagattatcttgagttatactactgtactttgaaaaaagaaaacttcttgtctatactgtaagagtttactttgagcatccccttgaaatccctgccagaactattagctagtactgttaaaagctatggtcatgttttgtattgtaccaagggtgtgtatgagagacagacaggaacaaagggacaatgtttaatgttccaatccaaacactaagcactacatctatttctctttacaagacacataacagctcggcatggtttcaattatgactgtgacgttaactgtagtgctgtgtcttctgtagcatcttctatctagattcttgagaaaagaaacagtgggaaagaatgggattaaaagatcatataaaataatatgcctggaaggatggtgagtcacagttctaaaaaataaacaactataacaaagcattaattttccataagcagaatggacataataaccaagggcaggttattaatacactgtgctttgcttattttaatcatgagaattccatgacttgagaattcaactcctggtaacagagctgaaaccctattaacctgttcaaataagcatttgcagggaggctgttaaagatatgtcaacaacatgagctcagttttttttcctccagtaatggaaaacacacatcgctgaggaccatgttttatgtgtctttaagagaactgggtcaaatgaaaataaatacgaggtgcgaggaaatacactcactgggatgatctgtccacacactccaatgggttcatgtcttgtaaaggtaaaatagtctccatctgaaagaaaaaagcatggtcactcccagaaagtttagattaggaaaaaaaatgcaaagggagaactttggtggctgcaaaaaaaaaaaaaaaaaaacaaacagaaataaacttgaaaaaacatcctactcaaccgtgcatgaaagctggtagaagcctaacactggacatagcatatttctggatatatctctcagacacccaaatgcagtattgaggaaaggatctctaaggcaaaatgaatgacaaatttatgatacaagaagtcctcagggtggcagaggggacagctgaaaaatatgtaaaaattgaattttatgttaaatattaaaataacatgtagaacagttgtttgatttaaaaactgagtcaacaaacctttaaataactttctgaagtattaaaataaactaagtaaaatgctattgggcaaatttaaaatgctcggcaactggaaaaagtgaggagtaaaagatatatttcataactcaatccaggtgtcaaaatgtacttcctgggtagtgatgagacataggcatgtccagggctatttaaagaaggtaaaagtccatttctaaaaagaactccatcaataatccaaagcgtctgcccccaaactagacatagaaatgagaatgtcctaggggctaaaagaaaaagagcttcagaaaaacttaataaccttgttttccttacaggagtaataggcaactgaaataattatacaggaagtccaaaccaaattcatctttaggaaaatgtcattgcttttatctgaattattttaaatggttaattaaaattaccaaagaatggctcatttttagcagatagcttttcattttaaatactgggcaaagtctttatttttccctccactgccggcccttaggccacttcactgatacttgttttctctctcaaaagcagtcccctaaggcaagtgaaaacactcagctaatattcatgaaagcataactattataggtggaaatgaaggtggggacaggaggactgtgtgggtcgggaaaagagaagcgatatgaatcagattgtttatcactgtctctcaacacacctaaatcacatttatcacacaaaattgttttgacatattcaaaattatttattttttaaataattacattaaagtcttggcctctctctctctctctctctcttactctcccagtgtcactctctatcctctggatctctgatctctaccccctcttgccataattatctgtttcctcttttcaaggaacttttattcacatacaagtatttataggatccttttatcctctttttttttatacaaacgggatattattcagtcttttatattttgtttttccctcttttttttttttttcctgtaaagctaggacgtctttttagtggctgcaggttattccatgggctcaataaacaatgttactactgtaaaccctcctactaagggacatagaagtcactttcagtttaggctattataaataatgctgcaaagactatcattacaaacatatcttttcatatctgtggaatttcttgatctaagtgtatgtacatttcagattttcaaaaatattgccaaatcacccttcagaaaagtttaacaattcataatttcaacaacacgctatttttcctactctttaacactgaggtttttccaacattttcatttcagctaatctgatagctggaaaactgcaacttgttttgatttatgtttaatgatagagtgaacatcttttcatgcttatattgtttgctatttttctattgggttattctttttagccatttgaagagctctatggatattaaggaaattaggcctctgtcataatattgcaaagatttttccccaatctgctacttatctcttgactttgttttatgtatattttaaatggaagaaattcagaagtaggctggattctgcaactgtatgaaattaatttaaaatatctattacgagaaaaaatagcgaagatgttgcaactgtccataggatgacagtatgaagtctgagtaatactttaaacatcaaattaactatttagctttgtatgcagataactaaagaatcttctggatatcattctttacaagactacaaattaccatgcttcttcaatttgtaaatctctgaaaaggtttttcatgaggagcaacaccactgatcaataagctagagtttcatttacaagaaaatcttctgcaactgaactctctaagttggttaaggtgatgggttcaggtggatagtcacagaccacagaatcagagagtaatgtcaagaaagagtgcaaatggggctgaggaaaaaaattggaagatgaacagaagagtacacgtgtttattttagcagcacatgtaggaacctggaatggttcagaaaaaaaaactcacaaggcaactacacaagcactgcatggcaattcataaaccatttccccctacacattttatgatgcttagacatttagttgttttacttaaataatatcacaagttaccgaaaaaagtgaaagggaagaaaatgtagacaaaaatcttaaaagtcggacctcatgaggaattgagtttgactccataattgtgtctcaagagaaactgagttatgaggaattaaaactctcttggataaaccgttcacatatttgaaaagcatttagctacaggctaacacagggaaagagacagaatcttctagtccctacagttagtctaagtagcaaattaaaaaataaacgctatttttgtgcttgaactcttcccaaaagagcactgagttgaagggacaaagaaaggaggctactttcaataaaattcaacattccttcaggttaaaaactctcaataaagtagaggcattgatggaacatacctcaaaataattaagagtcatttatggcaaactcacagccaatatcatactgaacaggcaaaagatggaagcattccccttgaaaactagcacaagacaaggatgccctctttcaccactcctattcaacatagtattggaagttctggccagttctttctcaggcaagagaaagaaataaagggcattcaaataggaagagagaaagtaaaactgtctctttttgcagatgacatggtcctatatctagaaaaccccattgtctcagcacaaaagcttcttaagctgataagcaacttcaactaagtctcaggatacagaatcaatgtgcaaaaatcacaaccattcctatacaccaacaatagacaagcagagagctaaatcatgaataaactcccattcataattgatacaaacagaataaagtacctaagaaatacagctaataaaggaagtgaaggacctcttcaaggagaactaaaaaccactaatcagggaaatcagagaggatacaaacaaatggaaaaacattccatgctcatggataggaagaatcaataccatgaaaatggctataatgcccaaagtaatttaaaaattcaatgctattgtcattaaactaccactgacattcttcacagaattagaaaaaataactttaaatttcatatggaacctaaagagcccatatagccaagacaatcctaagcaaaaagaacaaagctggaggcatcatgctacctgacttcaaactatactacaaggctacagtaaccaaaacaacatggtactggtacaaaaacagacacacagaccaatggaacagaatagagaaatcagagataagaccacacatctacaaccatctgatcttcgacaaacctgacaaaaacaaacaatggggaaaggattccccatataataaatggtgctgggaaaactagctagcaatatgcagaaaattaaaactggaccccttctttacatcttatacaaaaattacctcaagatgaattaaagacttaagtgcaaaacccaaaactatgaaaactctacaagaaaatctaggcaataccattcaggacatgggcataggcaagattgcatgatgaaaacgtcaaaagcaatcgcaacaaaagcaaaaattgacaatttggatctaattaaacaaaagagcttctgcacagcaaaaggaactatcagagtgaacagcctacagaatgggagaaattttttgcaatctatgcatctgacaaaggtctactatccagaatctacaaggaatttaaacaaatttagaagaaaaaaataaccccattaaaaagtgggcaaaaggacatgaacagacacttctcaaaagaagacagtcacgcagccaaaaaacatgaaaaaaagctcatcatcaatgatcattagagaaatgcaatctaaaccacaatgagaaaccatctcaccccactcagaagggcaattattaaaaagtcaagaaacaacagatgctggcaaaggtgtggaaaaataggaacactgttcctatttcccactttgtttacattcccactgttggtgggaatgtaaattagttcaaccattgtggaagacagtgtggcaattcctcaaagaccgagaaccagaaataccattttacccagcagtcccattactgagtatatacccaaaggaatataaatcattctgttataaagatacatgcatgtgtatgttcattgcagcactattcacaatagcaaagacgtggaatcaacccaaatccccatcaatgatagactggataaagagaatgtggtatatatacatcaaggaatactatgcagccataaaaaggaatgggatcatgacctttgcagggacaatagatggagctggaagccattaacacaggaactaacacaggaacagaaaaccgaacatcacatattttcatgtattgggggagctgaacacacatggacacaggaaggggaacaacagacattggcacctttctggggaggggtgggggaaggcagaatatcaagataaatagctaatgcatgctgggcttaatacctaggtgatgggttgacaggtgcagcaaaccaccatggcacacgtttacctgtgtaacaaacctgcacaggtaatccagaactaaaataaaataaagggccctagaccttgtaatctcactttgcattttcacgtggatggtgaaaggtgacacccctagtctgatctggggtgcctgacaaacacaagagctaagccttctgtgggcaccttcagctagggctaacagcaccccagaagtcattcacagctactaagaccctactatgaattccactgaacttctaaatcagggttaccgtaagaccagttataaaagccatcttcataatttttgccatttccaagtatcatttgctctgtcatttacttaatttctgttaaattaactcacctgttagaaatatgtaaatagctacctgttagccttaaggaaaatctaaaatctaaaataacaggtttcatgggctggtaatattttcttctaatattcttcaaaccaaggaattaaaattaaaaaagtttacttgcttactgtatagaatcatcttgaatgctaccagtgctacacgggatgctatatggtgattctcaaacttgaatgtacacactaagcaactggagatctcgtgaatatacagattctgaatcaacaggtctaggatgggaccagagagtctgcatttctacatgctctcagctgaggctcatgcttctgatccacagaccacactctgagtagcaagatcaggagtgtaaaggggagtccacgtgtattatgatgccctatggttgcttcacagttgtctgccttcatttttatttattttttgtctctctaataactctactaattttcctgaaaggagtatatagtgtaggagaatctgatctgtatttttaatacttcaaaattgttaaaaaaaaaaaaaaaaaaagaatgaaaacactattagaatttctgtagagccttataattttcacatccttatctcattttacactcaaaactctctgaaaaaaatagagcaactatcattatcagcatcttataaacagagaaaatatggcacagagaggttaagtccaaagtggcaccactggttgaggctcctggacttggatctgggtcttcagacttcaagttctttacccataaaaacatattaatgactcttgtgaggaaggtgttggatttaggtggataatcacaaatcacagaattagagtataatgtcaagaacaatcacaaatggggtaaaaataaacaaagaaaaaacctcaatgacaactcttttgtaatatgaacacagaacacatggaaacttgttataaagggaacactacagagaaacattccctggaataggtgagcccaggactaagcgcctctctccctttcatctaggcagagccaactcgaaatggagacagtgttaattctccctctcatctatacctcagatgatacataatgagtactcttctctgcctagaaaaaattaaagccaattttccatcttttatgctaacaatggtctctcagtatggcaggatgacttagaaggttgtttccttcatttctctagctttgtgctgtaagctcaacagcctgatataaaaacagtctccacccaaattcagatactccattgtagggtatgaatggttttggatcttcttagcaaatatgagggattacagagagtgctcagacttagcataaaaaaggactgcatttgatggggacaccagaaaatgttctggataccacattgtaggtcaataggtgagaacacaactatgatggagaaaactaaagaaaagatgagagatcaaaacaaatactaagtcacacgtgtaggacttttgatctctgtctcttttccctttcactcagaaggtaaaacgcagactaacagatattgctcttaaaggggggttattttaagacccagtcagaggtaacttttctgatgagttttgatacctgggtgcttttaatgaccaaatagtagtttacaacttatggaaaatataaaaatcttacaattaaatacttcattatgctatgaatttggctgagctgtgaattaaattttactgagtatgtgtgcattgagccatttctataattatattaagaacagcccttgctgctagagatcaacagtacaataagcctctactatatttgcgaactactgagccactgttctatgttttttgatggggccttatcaaactacacagaagagagagaaatatttaattagaaaaatttaattatttggataattcattcaaggcaaacattacttcttaaatcagatcttacagttgcctgaaagaaactgatggaatttttagtctcataaaaatatctcgcattggcacatcctatatattaatataaactagagtgagtatgactaagcaatctgtaaacagtgataaaatcagaagaatctgaaatgtgccagaaattgagaaatttgtcaaatatggaagtcaaatagcttccaattataacactaagaacactacaagaactgtagcaaattttatatacctagtaacaataaaaacgattttattcaatagcataaaaatctgtaacacaattcagtgaatgaaggtcatcttccaatccctaatttgtagacagaattacctttcaaggagctggcaattctttgatgaccacagtattaaaaaatgagatgattacattgaactattccattatgtatgtactgtagcagattcccatcatgttgacgttgaacagacctcacccaacattttataactatgatgataaactctataaatgcctatacaaacgctgaaactgtatgttagtatgaagtgtactgatgcttttcttcccagaagtctgctggtagtttctaagaagttagattatgttcctgagtctgtcatgaagatagcttagctctacgactattccactacatgatcgtaacaaaagttagtttacttctctggaccttctctgtaaaatcaggagatcagccttagggatccctgaggcccttttcagcttcaacctcttaaaaaggttccttgtgaagctgacttcatgacctcctgtcacaatcaattcaggtcccactaacaagcaagccctggttgttgttaggtgggcagagcaaatcacccctcactcttattctgatggaacaagaatacttcagatttcaccctatgcatttgttaatgacagtaaaccagatcaagctgattcaaggcaaaatcttaggatctgaatcactatctttgtgtatttgtatcctattctttaacaggttaaactggaagagggtgaaatggaaagttatatatgacctgggtagtttttaaccttttctatatgctaacatatcgtaagtccattttaatatcagaattcagcttaaaacatggacatttttttctgcttacataaaatcagtaaaatcaacacttgctacagagaaaaatctaaggcaatacaaattaacttccatttctccctaagtaaatgaaaaccaagcgttgatccttccttcatcacaaagaggttgtagacgtgagagaagaggatttgaatacaggttaaaaatactcaaaatggagaaaacaatacttttctttagggctgctataacattagcgataatgtaacaggtaaaaaagtgttccataggtcatagtaatgattattatttatcatcataattaggcactgccatcgtaaaagggtcaaagcttaggatttatggtcagagacaatggctccattgggtaccatggcaggaaataatggatagtgttgtaaaggaaacaacatcaagactcttgtgaatcaaactagtattgcataattgtgcaataacatccagctgtgggccttgagcgaaacagaatgaagagtggtgggagaaatttccaattcagagagagaagcagccacccactttttcattgctcaaaagtggtcatgagataacccttttgtctccttcccaagtattctagttgaaggctaccctttacggggagaaattaagcaggtatttgctctctctaactgattatccatctgtagtcaaagtgaaatctatcctttatggggagaaataaaacaagtacttgctgtctctaactgattatccatttgtagtcaaagtgctctttctaaaatgcaatttttcaaatagattcaacgggtttatgtgcagatttgttacatggatatattgcataactatgagccttgggcttctagtgcgcccatcaccagaatagtcaacgtggtacccaacaggtagttttcaatcctcagccccctctcactctccctccttttgaaggctcccaatgtgtattaggtctctccgtatgtccatgtttacctaccgcttagctctcacttataagtgaaagcatgtggtattagtttctgtttctgggttatttcacttatttcagtataatggcctccaaccccatccatgttgctgcaaaagaaatgatttcataatttttatggctgtgtagtatcccatgatttgtgtgtgtgcgtgtgtgtgtgtgtgtatatatatacatatatatatatattttatccagtcatccattgaacagcacttaggttcattttatttacaatagcccctccaaaatacctaacaatatttaattaaggaggtgaaagatctctacaagcagaagtacaaaatactaatgaaaaaaatcaccgatgacacaaatggaaaaacaccccatgttcatggattagaagactcaatattgttaaaatgaccatactttccaaagcaatatacagatttgatgcaattcctaaaatgtaattttgatcaaggcactcacctatttaatttggtgactcactattgcctacagaataaaacttgcagcatggctgacccagacttggggctctactgtctttcatatctgcttatacttttagatccactaactcatggtactctcctccctcatactttgtgccagctactcccactgcctgtaatgtccctgactccatgttcacttaacttgtccttcaggttatcacttagacatcccaccaccctctccaggaagccttaatactaggagatgtctctcctatggtgtcccaccaaatttcatgcttccatatctaaatagatcacactatattgcagttgcttcgctacttgtttttcttactgtcctataaacatcttagttatttgcctttgtaacccaatgcctaatacaggagctgaaacatagcagatgctaaaaaaaatctgctgaataaatgaatgtatgaagaaatgggtgaaggaataagagatcaaagttgatgccacagaaaggaggtaaaagaaaatcccttccaattacatgatacctttccctagccttcccaaatgggaatgagtgaaagacataatggcttatttcttcccattctttttggttgtttagtgttagagatgttatgctggatgaaccatggagtataattcaatgttgtaaagcagtcttacatctaaaaatttaacaacaaaaaaccctatttcaggttctttttttatgggtgaccaaacagaactgtgttactatctctgacactcactatgaaagccccctttacccatatgattaggatctaggcagggagatccccacctcaagtgttccagaacatttaagcttcataaatgctatcttgagaaaagtaggctctagatacagtcgattttcattatttgtggattccatatttaaggacttgcctactacctaaaatttatttgtaacccaaaaataagtacagagtgttctcagagtcatttacgggcatgtatatccaaagcagggatttttttttttttatttcaatagttttgggagtacaggtggtgtttggttacatgaataagttctttagcagtggtttccaagattttggtgcatctgtcacctgggtagtgtacactgtacccaatatgtagtcttttatcactcaccccactcccatccttccccaaagtccattataacagtcttacgcctttgcatcctcatagcttagcacttacttagaagtgagaatataagatatttggttttccattcctgagttacttcacttagaataatggcctccagctccattcaagatgttgcaaagaccattatttcattctgttttatgtcagagtagtattccatggtgcatatttaccacaccttctttatccactcgttggctgacgtgcagttaggttggtaccatatttttgcagtttcaaattgtactgctatagacatgcatgtgcatgtgtctttttcatataatgaattattttccctgggtaggtacacccattagtgggattgctggaccaaatggtagtgccacttttagttctttaaggaatctccatactgttttctgtagtgattgtactagtttacattcccaaccagcagtgtgtaaaagtgttccctctcaccacatccacgccaacatctattttttttatttttaaattatggactttttttttttttgcagtagtgaggtggttcagctgtggttttaatttgcatttccccaaagcagggaaaattttgagtcacctgatgcacaaattctcagctggggttgagcaaggtgacactctgccttcttgcttcagctctcatattgttaaaaaaaaaaaaaaaaagtgtccttttttgtggtctgtttagtgccacatttttcatatttttgtgccttttgttcacaattttgctgtttaaaatggcccctaagcatagtgttgagtgctgtctagtgttcctaagtgcaagaatgctgtaatgtgccttacagagaaaatacatgtgtcacacaagcttcattcaggcatcagttatagtacttctgtctggttggccatgagttcagtgttcataaatcaacaatatatattaaacaaagaatctttcaacagaaacacataaatcaaggccattctctgatcagcagacaagaatgttgtgatcagaagctcacaggaacctaatcttttatttcccctaggagcaatagttccatatttgctaattcagtgttcgtgacaactttataaaacataactactatgaatgatgagaataaaccatatattagtataaaaatctgcactggggtaaagacttcatcatattagtataaaaatctgcactggggtaaagacttcatcagggccaccttcctgccttgctgaaccaatctccataagaagagaatttatcatggcttaggcagaacaacacttaagtttgaatctcacgtctcccacttactagccatgtgaccttctacaagacactaaacccttgcagtcttattttcttagatgtaaaatgggtaaaataccatttaaaatccagactatctcatcagatcacacacagaatcacatagatattgtacataaaagaatattttatacttttaaattctatgcaaatataaagtacattatttctttataattcccaacataaaattaggttgttttgtaggaaaatgcatttagcacaataaagatctcatggttaaagactaacggactttctatattccagacttcactgtgaaaaaaaaaaaagccaagtatgcagagacaaaatgaagctgatgttaaattatggagttacaaaagacaaatacaaatggattaatttactgaacaaatttgagaacaagtgaataattatgattacgatacccctttctgtgatcttcccctatgactcccctgatttagtccagctacattcactaagcactagactagctaaagacattgttggctgaattctaagtggcctctaggcaagcccaaatgtatctaaaactggaaaagagaggacagctgccaagttaacctctacctccatccttccctcatctgtttgagacaccatggagagagctcttatgacccaaacttcagcctcctgagaattctgtcaacaggcctgatggcagggagggtacctcatcctagtatgactctaaatgcactttcagaaaaactttttggggaaaaacagttacttagagtttaagagaattcatcgttttttttccttcattgactgaacaacagttaatgagtaaagtggggaaagactactgtgagagccctatgagagccttttctatgccctgtatttataactcgtagataagcatccacaggatctccaaaacgcatcagatgaaaacagtgaggcttatgggccaaccacctctattgccagatcaagttacattaaagcttcaaacattatcagggatgtcaatcaatatttagctttatctaatcaggatcttccctcctgaggaagtaaaagaaaaccaaggtaccgttaggccaaatagagatctatgtgcattgccttctgtttcacaatcttcctcagagctttgtaaatagtttgaaaagatatttaaacacctgaaacatatttgttgttttaataatgaaatgacaggtggagtggggaccaaaaaaaccaacaactagggactttgatcttgtaaatttacctttctgtactgatacaggacaggcccacctaaaaagactgacatgtgtcccactgttgacaaaggttttaattctcaggccctctaataggtatgctcataacgaatagtgactttctacctcacttaggccatccccacatcttgcaagtgatgctggaaaacagctgttctgtaatatccttagagtcagaactgaactaagattctgactttccccaagggcaatcttctccacccttctcagtcagttgaacaagggaaaaacctctagatggaagggaagagcccctacaatcagaaacccattttctaaaaactaacattccacatgtcatcatcatttgtaggggcaatttaaaaaataatccttggaagtcttgtctctaaatcatctccattctcactgtaaattattcttacccttgtcataccacacctacatgaggcatcacaacagccacctaacttggttctgctgcatcctctccttgctactcaatgcagaggaccagaagctggttagacatgcagagtctcaggccccaccccagacttattcagtcaaaaactgcacttgaaaaagaccctcagtgattcatgagcacattaaattggagaagaactattcccagccatccacactatcagccaaaccactcccttttttagtaaatcagtactgctcagcctggctaagaaggcccaaaagagacacttcgaagtcctgagcattactttccaatcctgctactatgcactctccatggaaagcagactgccttctggagaacacaggtagaacacctggcacagtgctaagtggcatctagtatccactcaataaatgtgcatttcctttccttatgtctattcaccacttactatctctttcagtccatccctttcctataaggatatctcttcctcctaggatctattttgaattctctaatgaagtggttacaagcctaggttctaacgtcaaagttttagctctaaaacttatttactctgtgaattaggaaaactaattttacttcgccagacctctttccacttttgtaaactgaagatgtttgtaacagtgcctttctcttggggttgctgtgaaagcactcaattggtattagctatcactagtattcaagcacagataaaaatctcttcactgactgctttagttgctttagtcttccatactttccctctcatttaaagggctacagcactgacaggtaaagtacacaacttagcacccaattataacactcctataggggcctttaagttttttgtattgttgattctgtcatgtaacctgaatcttaataataaaaaggggttaggattagtgttgtttgtatagattatgaaagtaattcacggccgttcgagaaatatagaaagtagagaaaaatattaaaaagacactgaaaatcagccataatctcaccactcagagacaactgttaacacttagaatatttccttccaaagagtagatcttatatgtttcaggagggcaaggagcaagtcttaacctcgttggaattttccatgacttccctccacccaataatgccccttcatacctaccccagcacctaatctagcacaatgctgaccacttaccagctgacaaatacatacctcttccttagatgaatgatgtattaagtggcatgcccctgtacttatatatttctatctatagaaaaagggatgttgtcagagtcagtgacataatttggttggttcttcactcagttctaactgctgtaagtgtgctcatatctgtattctgtgtgactgctgtttgtgtttggtggccaaagcgcatttctggtggtttcacgttttccttttcaacgtactcagatttcacatacctacaggaatggtcatcccatgaattttatcagcccagcctgcgtaatatcgaaaggttttgatgacgccctgcaaatccacataaaaagcttgcaggaatggtttgccaccatttagggattccatggtctgttggaagagaaatggagagatactaagtccccagaactttccagcgatacactaatttctagagcagaagaaaaaaggaagagagagaatacaaatgcatatggagttgcatacctggtcaactatgaattctcaaataaaaagatttctagtactgccagtttggtctagttcctagtaaaaaccacaatgagtatatatgtgcatattcctgtgcttccagtaaccactatccaaatacgttaacacaatatttctttaactaatgataaagaaatgttctgcttgtcaaaacagcttccgttatattaatgatcagagctcactggggattttttggcatctacaccagtaatctgaatccataaagaggagcagaaacatgggctctttatgcaactgatgagaatagaaagtgttctccacagctgccaagacccctgctgagaaatggaatatccatggtgcacagcaagtttatttattaccaccaaataaacaagatctcctctagggaagcccagatgttaacaacttaaaggctggttttttgtaaacatttacattaacaaccattacctattaagagtgaaatatctgctccatttaataaaaatagcaatattgaactgctttacattataaacattgttattttaacgacatgttcctgaactggctaagtccgtaacaaaaacaatgaacacgctgaaatgagaagagtattttgacttgagaaatattaaaggtgttacaagttcgacaaatgaaattaacaaacatgtttgtaattttctttttttcctacaagtgtattttataagacatactggtgtgaaaattatttgatctctgacaaagctaaaattaaaatattctccaatcaatgagatgaaaatactatgacttccagtgtaatttatctacttagtatgtgtataaaatgaagcttatttaaaaatatcatgttacttatcactgtatattggctcacccttaaaaaagggaatcaaactatttcctagtactttttagaacatgtatatgtttacaagataggcattacattctctatacagctagcatagcaccaaaatctgcacagcttagagtgaatagtgtcaataaccagaatttgggctgcctaaatggtccctgtgagctgccgacaccagtcaaatccactgacaattgccagctctaggactattttcaattgtgtttactttggatgcaggattagcttcagttttccagtcaggagctcccctttcttccacaggctacctcttactaaaactcacttttctcatagcttgagagtgtttaaaacaggaatctcatttaggtgtggtaggaaaagagacctgatcagtgagacacagagaagaaaaagaaaggcatttgagttttattatatgaaaatataactggagaaattaattaatcatcttctagcacagtgttaatccaatgctatagatatcatatatctttagctcaattaaacagtcatttattgacaacctatgtgccctcatttgccatttatgtgctaagaaccatgctaggattaccaaaaaaaggtaaaatacaagtttaattctcaagaaaatgataatccagtgaaaagacaagtaatgtgtcccaaaaaacttggttttgcatgatattggtatgttagccagaaaaatggtgatgagactcaaataagcttgagaagcatttagtaggcttttcctgagcctttaatatgcccagtgtcttgtgaatctgcaaggaggaatttcttcaccatgaaacacctttttcacagtatgaataaacacctcattggaagagtattccctagagtgccagattagaaaatatttttatatacacataaatgttatatatagctagaatcccaaaccatttccataaaggaatcattttgttcccatactatgaacagattcctgagggggatggtagaagggaagaactatggtaggagggacactgagaaagggaaaaaatgattccttccccagaagcaagcccaatagtgacctattttcccaagtaggggaaaggatatagtactcatggcttgaatgccctgactgaacaaggaaaccctaaatattcattgataccaggtggagatcccaaatgtatagtgcatacattcctaaatgctttcagtttccaaaaagtttatattctctaagaaattgacttttattttaaaaacagcaacaacaacaaaacccattagggcaggagaagttcgttatgtgaggaaaatcattgttttagtgaaaggaagttgctatctcctgctgtctctcctttctactggctcacagaatgacagggcaaacggagcagaagtgtatgagaggtccgtaccatcccctctggttctgaaggattccttttactcaagagaggttaactctggggaggtaaaaacttgttctatttcattctcataagaatcatttgatactcgttttctgcaagcagcatggtgactctcttgttgcttgactgtttttaatttgtcatggggagggggagttttagaaaagaaggtacttaccagtcatggcaagctccagttttctcttcaaaattcagtgagaaaagatattcagctgatcctccatttctccttctccatctgatccccaaatccaaacatgtctcatttttcatatgtattacctattcctttgctttttccccaggtctgcttcaaagtatccttttaggagctcaagaccagcctgaccaacatagtgaaaccccgtctctactaaaaatacaaaaattagccaggtgtggtggcacgtgcacgtaatcccagctactcaggaggctgaggcaggagaatcgcttgtacctgggaggcagaggttgcagtgagctgaaatcgtgccactgcgctccagcctgggcgacagagctagactccgtctcaaaaaataaaataaataaaaataaaataaaatacagccgaagaatgtaaatttcagcagaatggcaaatgtgggttaaagacttaatgttttcttaggttacttactgcaagaactgccctgtcccgttccaccaagtctgcaagcttatccaacagacgtcccctttctgaagcatccatccttctccacactgaaccaagagagaaagccaggcgggctgcctgcactgctttgtctatatctgcctgttagagaggaagaggcacaactgaagaaaaacactccaaataaaggaagaaccatccactgtcatgaaaaaagtgaagcatgagcatgtagtggtgtactgagagcatatgtttgctgctctgctgtttgaaggcagttatttcataggaaatcttttatctacaaaagacataccttgtctgcttcttgaacttcacacacctgttctcctgtggctggattatagacagggaacactctcccactctctgagttctgccactcgttgtttataaagatctaagggagtagataacagaatgggatctgtgacacaggtgataagcagccagtcaacggccaagtgttacggaactactatggtaataacacttgttgtataataaaagtatacaatttgaagtgttttaagagacccttctagactcaacgccaatttaggaatttcctctatatttttgctttaacatcatccaaaggctaactacagttcttacctttcatgaacctgtcaactaactaaagatacaaataaggatagagtgtctcacatacatacaatcatacactgatgctaaggcaagagttatcgatagcccaagctctggctagtatccatgagggttaaatagcagatcaaacttacagtcatcaagccttagatcctactttctctgccacaggcctaagtgacttctcaaggaaacttgaatggtgctgcaataagcattcacctaatttatactcaggtcctgaacaatgactctaaccaaactaactagttagttcaacaagttatatgtgtaaatccaagttagatttatttccctttgctgaataggctatcttgcagagccaaaaaagatggggatggggagttagcaagtggggtgtaattttcaaatgatcaccccaggatttcttaaaaggcttggtctccctatgtatgaaattgagattaaaatggcaaagagactgaagatttgggaaattattcaagtcaatttctcacaagatttgtaataaatgagttaaaggacaagggaaaagaaaaggccagaaaaattttaaattcttattgagtgagaaacctaaactaatatttttagaccatgtaatcttagaggacatacgaagatgttttactctataaaatttacagcaccacagtgaaatttctgaacttatgaaccagtcagtcatctaatttaggacaaaaacaatgataattatttagtgcctgccatttaaaaaataatcagagatgaggcttaataaatataaatctacacttggtaaatatcaaattctagaaaatgtcccaaagctttccttttacatgttttccttgatttgataaaaactatgagcccatgtagaaggaggcactgattaaactataactttcttttcccaaaggatttttaagataaaggaaaataccttaaatttgtagagcacttaacacagctgtattgatacaaacaaaatgaccttgtaattgtacattttacagtttataatacacagttcataaacacatgtaacaaaatttacccaataaatactcagataacttctagtcacaggaaaaataaagatggttaagagagttccagccctccagagtctgacagtctctagtagtttatttagtacttacaataaccccgtgaagcagggttttctctctattacacatgagaaaattgagaggcagggagcttgagtccaaagaagcaggttcttgttgtggctgactcaacaatgtgttctttccaatacacataatttccaggattagtcagcccaaagaaacagaactagttaatgtccaagcctgagctagttagaattcttaaattattggtctggttctcttttcattcactctatttaataaatttgctcacagctgatagctcattacattttcatgctcctttgaacacagtataaagtccaggtaacaaaaggagaaaattaaaaagttagtttcattaaggatccacttcttgggtattatcaggtttagggaaaaagtggtcttacccatgtccctatccttttattcaccatgtgactgaatcaaactttttaacctttgcagtatcaccaaggcccactgatcctaatttttttttttttttttttttaagacagagccttgatctgtcacccaggctagagtgcagtggcactcaatctcagctcaatgcaacctctgccgcccggggttcaagtgattctgctgcctcagcctcccgagtagcagggattacaggcacccaccaccatgcccagctaatttttgtatttttagtagagacggggtttcaccttgttggccaggctggtcatgaacccctgacctcaggtgatctgcctgcctcccaaagtgctgggattacaggcgtgagccactgcacccggccccaagttcagtttttaggtttctctgtgcagcagttttaattatttgtaaagactgatatttcatgacttttgtttcttacaggttttccaaaaatcaaaaggaaaaaatacttatttttagtaagttaaactcattttcttcatcacttagtctattgatcattttataaatctaagatgcattataggatctaagatacattatgatattttagtgatcttatatttcctgtattttaaagtattttgctacttcatcatgctagaaattacttcatcatcactcatcaattatttctaattgtgctaaaaaactaaaataaggaaaaaaaaattacgaaattgcctagaaatgaatgtcaccactgtatcatccttccgttttctaattgtgttgtgtaatacatctttcaaaaagttataaaagaagtctagagatgccatctttgccatattcttttcagcttccattaaacaaagttaagaatttggaattcttaattttctgcccataatgggataaagaataaaattaagagaaagatatttcacaataattagatgaatgagaaaatgaaggcagagacagagcacttgagattctaatgatgaggtaaaactgaccatagaagcaaaatcttgggctatgagtccttcagataaattctgtcagacttgagaatcagagtaaacaatatatttacaaagacaaaaaggaaacatgatattctaacccattaattatttaataggaaggacttcatcatttagtattttgcacaagaacctggaccatcctgctctgataaaaggacatatgacaattattttatcttttatagtatttgttgataaaatttacttgatattcataaatggacaaatgctgaaggtaggtatatatgtaaaggtgactggaacagacagacattatgtagaaattttaaaagttcattgggttgctcaatctgattgacatttataaaagtaaaaatgaaaatatttttgtaattgtgaaacaaaaacatggccaccttcttttctacaaaatcatgaaccctcaaatttctccatagcattacactgtgataataatgcatatgcaggaagaaccagagataatgatgagctataacctactagagatctgtttaaaatctggagccagtatttacgagatgataatgttctaggttcatatacgacagctcatgaccagttatttgcattcaaaggcattgccaatttcaggttacattacctccaaaatcaggaaaatatgaaataaaaacgtggtttgctatgtttaaattcttattttgctgttttttttaccatctctttattcttacttctgtaaattattcataaaaataaaaataaaaataaaatgaatacattgaaaccagatggtaaatgtgatggctatttttcctggtgtgccaaaattaaaattttaattttactacattattatttttgtagacctagtcttataaaatgacacttaaaaaattatatggacaactttgttggtacatggaataacaaatatcttcatggtcagtacttgaatgtttgcagctctctaggcaatgtcgaaagttttgaatcctgtccatagcattattccctgaccagggctccttggagaaatggtttatttcagaactgtatcagggaaagtacaagatgagcctggaacattgtggtgcctgaaatcaagtaaatacttaaaaatggataggaagataataaaaagatacagaagtcaccatgaagaggctaccaatggacaatactggaataatttaaacaaaaaataaataatgctggtaatagattatgacccatagaatgaaaaagacatccaaaagttcataatgatatacatttttaaatgaataaataaataaatgtgggataaggaggcgctcttcttcacagtagaattccaactactagatgtgaagagatgatgggattagatgattattatttgtaaaataccatagtaataactgcttcaggtaaaaatcatcactagatagtaaaattggtgggcaaatatgcaatgaaaaatgtatgatgtatattcatgtagtttcaaaatatctcccctcaagatacttaattacaaaagaaaaaatagtaactttatgttggagaaacttggcagacaccaccttaatcaaatgattaaagctgatgtcaccagcaatgggacaaattgatatcatgtgcagctgatatgatatgctgagaaagacaagatcagttctgtggtaatcttacccaaaaggcataacctaaattcaaacatgaggatacaacaggcaaatccaaactaaagcatattccacaaaataattgtcctatacttacttaaagtgccaaggtcatgagaggctagtaaaatgaaaacaactgttccaaattaaaggtcactaataagacataaaaattaaatgcatcatgtaaccatggattctctgatgggccaggaaaaaaaatacatattattgggacaattggtgaaatttgaataagatttttaggttagatgataatattttgtcaatgttaatttcctgatttttataacttttataattgtaagatcatttggggaatctgcatgaagtgtacacagaaatttttgcactatttttgaactttatttttgtaaatctgaaattatttcaaaatggaaagcaaaaaaaaaagtttaaaagtcagtgtcatctttcagtgcctacctttcatattttaaatgccccaaacaaatttgttaaacgaagaaacgaggattcaacatcttcacaagagtttctttaaatgtgactttgtggaaaataaaataagccactcaagctctgtcttgaaacatggcccaatgatgccaaatcattttaagttaaagccatgttaatctcagtataagaaaccagaatattttgctttgtagtttactgaatttcagaattagtatgaggaaaaatgtgggctttactacagaggtctttgaaagtagaaagtgtatctgaccctaagttactggactgttgctcagtttcttcatttggaaaatatagaaatgctgacttactaaaatcatgtaattctgtgatgctgtaaccgaaggtaaaaagaacagatggtccataaaagaaggcacctatctaatctaggtttctcagaggttggagggattagttcatatccctttctttccattgtggttgtgaaggactaactgtccactgacatattataggttgttgttggttttaaaaagacagaatgataggcacttagctaacattaaccaaaatggaatgtctgctgagagaggaaatgaatcactttcttttttattattattttttaaatgttatttaagttctgggatacatgtgcaggacatgcaggtttgttatgcatgtaaacatgtgccacggtggtttgctgcacctatcatcacatcacctaggtttaagccccccatgcattagcttttttatcctgatgctctccctccgcccaccccctccaacaggccccagcatgtgttattcccttccttgaatccaagtgttctcattgtgcaactcccacttataagtgagaacatgtggtgtttggttttctgttcctgtgttagtttgctgaggataatggcttccagctccatccaagtacctgtaaaggatatgatctcattcctttgtatggctgcatagtattccacggtgtatatgtaccacattttctttatccattgatgggtatttgggttgattccacacctttgctattgtgaatagtgctgcaatgaacatacgtgtgcatgtatctttataatatgatttatattcctttgggtgtatacccagtaatgggattgctaggtcaaatggtattgacatgaatcactttctaacatctttcctgatatggtcagaaatacagtacctcccacaccaagaacaaatctgaaacacactgaagaacgaggagaatatgtgaggaacaaaattttcttatatttaatagatgtggtaaaaacatatgtaatataaatgcaagctaagatctaccatattaaaatataccatgaacacatcattcaagcactggaacattattagtattactgaagctacctgtgtgtttcttcctaatcccgtcctccagcttgacccaccctgccactagaggtaaccactaacctgtatttttaatttatttattcttagatattttctttcattttcttgatcaaatgtagtatttatttgatgcaggtttctgtgtttattgtatcaattttgtaaaatgcattaggatcatcttgattgtcattaacgttttatgtttgtactatgatcactgagaaagccatgctgaaatttcccatggtggtggatttatcaacatattccttaactctaaatttctacctttataattttcggggtattttattagtgaatataagttcataaccattagatctctctggtaaaccatttatcaatatgaagtgatgctctttattactaataaagcttccaattttagagcctattttgtttaatagtagcatagctacccaagcctttctccagtatttgtctcatttatcttttcctgtctttctgctctcaactatatctttattattttgatgtgtctctgtaagtgacatatggttagattttatttaatatgaaaatctgcattttaactagcaagtttaatatatttctattaactttttgagttggggagggttcactagaagcagtttatatgactgactcctccacttagaaaaaccagaacagtatatagacagtcacacttcaaatatattatccaagagaacaccggaattcaacaaagaagggacaggaagcaccaaaagtaagaaaagaggttgcctcttgcatcctccctgactgggatcagctgggagccaggagtgatttcccaaagtgggaaatgggtgagtgggagacttccagcagccaacatccccaccgtggaattgtgcaattctggccacttgaaaagccctcaatcctcccaagccccgaaactaacacagggagctgccaagagaccatgaaatggaactgctcctaggagagaacttaacactgggccccacatcctttctgagacctaagcagctacagcaaggcatcatttccaaacctagcctttgacaaacgtcgtgctgtcctggggcccagcagttccaggactgaggcattaaggaaactcaggctattactgctgggacagcagggcaagctgggagtgctcctgtagccaaggctaagaagccagtgagacatgagctgaagcacccagtgctggtagacatgtgttgctgagatctaagatggagacacaagttgctgctggaattggtggtgagctgggcaggggttgctgcagctggtgcaggcggatgagttaggtgcaggctaccgccaccagggtaggggatcaagcctcactaaaactggggcatgaaagaggcacaattccccacctgccggtccaggctgtggccactgatgatggccaaatcctctccagtggcagggcctcaatgcagctgctactgcccctcactcaagcactctgcctagggcctaagaattgccctgcccctgcccatcacagctagtgcctcctctcaccactgtgggggctgaacaaaagcccatctggcctcactttgttccccattcccgagacagagcacatagattgaggtcctggagattgcccaacccaatctaccaccttgggtacctgaacattccgtacagggtactgaggttgggcctaacttcccagccactaccacataagctgaaatctacctgcaagtgcaacctcgggcctggagacttgcctgtccagcacatcacagccactcccaatatccatgcacactactcaggatgcagaggatcatcctactactgctactgccattgccatgccatacaagctgcctagggacctgagaacacatccaaccacctggtccactgctgccactacctccggggggaaagccacctcaaggccaagaatcagcctgctccaacacaggtgccagggtattccacactgaggcacaaagacaggcacactcaacccaccactgcaaccactagggcctaaagactggcctacctggcatcccagtcctcagcacaacttcaccacagcctctgctaataaccacactataacttaccaaggaaatcacagatatcactgatgttgtttactgccaaagaaatcatatagagactacaccactgcatccacccagaatcaaagccaaaatgccccatccaaccaacaccatatatacaccttcaggaaaaattcctcccctatgaaagtaaattcaaaaataggaagaaccaactgttataccagatgtgcagatatcaacataaggacaacatgaaaaagcgaagaaatatgacacctccaaaggaacaccatactccatcaacagatcttaatcagaaaatttcaaaatcccagataaagaattcaaaatattgactttcaagaatcttagtgagatacaagtgaattctgaacataaaaaatcagaaaaataattcaggaaataaatgagaaacttaccaaagagataaatttttttttaaagaaacaaatagaaatctggaacagaataattcattgaagggaaaaaaatgcatttaaaatcttagaaccaggcaaaataatttctaatcttcaagacaggtcttttgaaataatccagtaaaacaaaacaaagaacagagaatttaaagaatataagcaaagcctttgtgacacttgggacaattttaaagtgaccaaatttacaaattattagtataatcaagaaacaagaaacaaagatgaaaacttgccaagcctagcaatatttaacacatgcagatacaggatgcttaatgattctcaggcagatacaatatgaaaaggttttctacatagcatattgttatcagactgtctgaagtcaatgataaagagaaaatcctaacaacagcaacagaaaagcatctagtcacctataaaggaaaccccatcaaactaacagcagatttctcagcagaaaccttacaggccagaagagaatgagatggtatattcaaagtgctgggaaaaaaaaaaaaggaactgccaacccagaatattatctctagcaaaattatccttcacaaatgagggcgaaatagactgattcccagataagcaaagactgaaggaattcattaccactaggactgaccctacaagaaatgctcaaaatagggctgggcagggtggtgcatgcttgtaatcccagcattttgggaggccgaggtgggtggagcacctgaggttgggagctcaagaccagcctgaccaaatcatggagaaacctcctctccactgaaaatacaaaattagccaggcgtggtggcacatgcctgtaatctcagctactgggaaggctgaggcaggagaatcgcttgaacctgggaggtggaggttgcagtgagctgagattgcaccattgcactccagcctgggcaacaaaagcaaaattccatctcaaaaaaaatgctcaaaatattaactctgaaatatggaagtataaaactcatttgtaaagtaatcacacaaaggaggaagagaaaagactcaaatggtaccactacaggaatccaaactacagtgtaaacaataagaaaaaaaaagaggcaaagaatatataaaacaaccagaaaagagatataatggctgaatggatttttaaaaaatgatccaattttatactgcctagaagaaactcactttaccagtaaagacaaatgtagactgaaagttaagagatgaaaaaaagtgaaaaaagatattccactcacatggaaaccaaatgtgagcaggagtagctgtatttatatcagataaaaacagattttaagccaagaagttcattatataatatgagggaatcaattcaacaagagaatataaaatctaaatatatatgtatcaaacactggagcacccagattcatagagcaaatattactagatctaaatagacagactacaatacaatagtgggggacttcaacaccctcactgtcagcactagacagatcatctaggcagaaaatcaaccaaaaagcactggatttaaactagactttacaccaaatagacctaacattctatccaactactgcagactatacatccttttcatcagcacatgcaatattctccagaacagaccatatgttggaccacaaaataaatctcagcaatttttaaaaaatcatatcaagtatctcctcagacaacaaaggaataaaactagaaatcaatgccaagaacaactctggaaacgatacaaatacatggaaattaaacaacatgctcctgaatgaccactgtgtcaacaaataaaaatagaaatttaaaaacttcttgaaacaaatgaaaagagaaacaacataccaaaactcttgggaataacaaaagcagtgctaagaggaaattttatagcaattaatgcctacatctaaaaaaagtagaaagattataaattaataatctttatcaatgtaccttgagaaactagaaaaacgcgaagaaaccaaaccccaaattagcagaagaaaataaataataaagatcagatgtaactaaatgaaacagagactaaaaagaatacaacaggatcaacaaaacaaaaagctggttctttgaagagataaacaaaatcgataaactgctacctagactaacctaaaaaggagaagaatcaaacaaaatcagaattgaaaattgaaaacagagacattacaatggataccacagtaatctctgaagaactacacattgacaaactgaaaaacctaggggagatggatacattcctggaaacatataagctaccaagattgaatcaggaagaaacagaaaacctgaacagctcaataacaagcagcaatattgaatcagtaataacaaggttctcaataaagaaaagcccaagacaagaatccagccaaattctaccaaacatacaaagaataactaacatcaatcctcctgaaactattcaaaaaaatcaaacaggaggaatgtgttagtctgttttgtattgccgtaaaggaatacctgaggatagataatttaaaaagaatttatcttggcttatgattctgcaggccatatgagaagtagggtgccagcatctgctcttagtgaggccacaggaagcttacaatcacggcagaatgtgaaggggaagcaggtgtgttacatggtgacagagagagcaagagagaaaagaggaaatgccagacttctttaaacaactagctctcatgtgaactcacagagcaagaactcactcattacctcagagagtgcaccaagccactactgacagatccagtcccatgaaacaaacacctcccaccaggctccacctccaacattggggatcacattgccacatgagatttggaggggacatacatccaaaccatatcaagggaattctctctaaatcattctataaggctagcatcaccctaataccaaaatcagacaaggatacaacaacaaaataagaaaactacaagccaatatccctgatgaaatagacacaaaaatcttcaacaaaatactaacaaacctaaatcaacagcacattgaaaagataacacactatgataaagtaggatttttaccaggaatgcaaggatggttcaacatacacaaatcagcaaacatgatacactgaaaatctacagaatgaaggaccaaaaccatataatcatctcaatagatgcagaaaaagcatttgataaaatcaacatcccactcctatcggtatgcttccaagatggccaaatagtaagagctctggtctgcagctcccagcaaggtgaacacagaagacaggtgatttctgcatttccaactaaggtacccggttcatttcactgggactggttcgacagtgggtgcagcccacagagggtgagccaacgcagggtgggacatcacctcacccaggaagcacaaggggtcaggggatttccctttcctagccaagggaagccatgacagattgtacgtggaggaacagtacactcttgcccaaatactgtgctattcccacagtcttagcaagcagcagaccaacgtattccctcccatgccaggttcggcgggtcccatgcccacggagccttgctcactgctagtgcagcagtctgagattgacctccaaggctgcagcctggtcggaggaggggtgtctgccattgctgaggcttgagtagcaggtaaacaaagtggccagaagattgaactgggtggagcccactacagctcagcaagccctactgcctctctagactccacctctgtgggcagggcatagctgaacaaaaggcagcagacaacttctgcagacttaaacgtccctgaagacagggacagctctgaagacagcagtggttttcccagcacggtgtttgagctatgagaatggacaaactgcctcctcaagtgggtccctgacacccactgtaggctgactgggagaccctcccagtaggggcctaaagacacctcatacaggcaggtgcccctctgagatgaagcttccagaggaaggattaggcagcaatatttgctgttctgcattatttgctcttctgcagtctctgctggtgatacccaggcaaacagtggacctacagcaaactccaacagacctgcagctgaggggcctgactgttagaaggaaaactaacaaacagaaaggaatagcatcaacatcaacaaaaacgacatccacaccaaaaccccatttgtaggtcaccaatatcaaagaccaaaggtagataaaaccacaaagatggggagaagagaaacctgagcagaaaaggtgaaaattctaaaaaccagagcacctcttcttctccaaaggatcacagctcctcaccagcaatggaacaaaactgcactgtgaatgagtttgatgagttgacagaagtaggcttcagaaggtcggtaataacaaacttctctgagctaaaggagcatgttctaacccatcacaagaaatctaaaaaccttgaaaaaggttagatgaatggctaactagaataaacagtgtagagaagaccttaaatgacctgatggagctgaaaaccatggcaccagaacttcgtaatgcacatacaagcttcaatagctgattcaatcaagtagaagaaaggctatcagtgattgaagatcaaattaatgaaataaagcgagaaaataagattagagaaaaaagagtgaaaagaaagaaacaaagcctccaagaaatatgggactatgtgaaaagaccaactctatgtttgattggtgtacctgaaagtgacggggacaatggaaccaagttagaaaacactcttcaggacattatccaggagaacttccccaacctagcaaggcaggccagcattcaaatttaggaaatacagagaccaccacaaagatattcctcaagaagagcaaccccaagacacataaatcgccagattcaccaaggttgaaatgaaggaaaaaatgttaagggcagccagagagaaaggtaaggttacccacaaatggaagcccatcagactaacagcagatcccttggcagaagctctaaaagccagaagagagtgggggccaatattcaacattcttaaagaaaagaattttcaacccagaatttcccatccagccaaactaagcttcataagtgaaggagaaataaaatccttcacaaacaagcaaatgctgagagattttgtcaccaccagtcctgccttacaagagctcctgaaagaagcactaaacatggaaaggaacaactggtaccagccactgcaaaaaacatgcaaaattgtaaagaccatccatgctatgaagaaactgcatcaattaacgggcaaaataaccaactaacatcataatgacaggatcaaattcacacataacaatattaaccttaaatgtaaatgggctaaatgccctaattaaaagacacagactgctaaattggatagagtcaagacccataagtatgctgtattcaagatactgatctcaactgcagagacacacacaggctcaaaataaagggatggaggaatatctaccaagcaaatggaaagcaaaaacaaaagcaggggttgcaatcccagtctgatgaaacagactttaaaccaacaaagatcaaaagagacaaaaaaggccattacataatggtatagggatcaattcaacaagaagagctaactatcctaaacacatatgcacccaatacaggagcacccagactcatgaagcaagtccttagagacctacaaagagacttagactcccacacaataataatgggagactttaacaccccactgtcaatattagatacatctacaagaaagaaggttaacaaggatatccaggacttgaactcagcactgaaccaagtggaccaagtctattaagactctctaccccaaatcaacacaatatacattcttctcagcaccacatcgcacttactctaaaactgaccacataatttgaagtaaaacactcctcagcaaatgtaaaagaacagaaatcacaacaaactgtctctcagaccacagtgcaatcaaattagaactcagggtaagaaactcactcaaaaccgcataactacatggaaactgaacaacctgctcctgaatgactactgggtaaataacgaaatgaaggcagaaataaagatgttctttgaaaccaatgagaacaaagacacaacgtaccagaatctctgggacacatttaaagcagtgtgtagagggaaatttatagcagtaaatgcccacaagagaaagcaggaaagatctaaactcaaccccctaacatcacaattaaaagaactagagaagcaacagcaaacaaattcaaaagctagcagaaggcaagaaataactaagatgagagcagaactgaaggagatagagacataaaaatcccctaaaaaaaaaaaaaaatcgatgaatccaggagctggttttttgaaaagatcaacaaaacagatatactgctagcaagactaataaaaaagagagaaaaatcaaataaaaatgataaagggaatatcaccaccgattccacagaaatacaaactaccatcagagaatactataaacacctctatgcaaataaactagaaaatctagaagaaatggataaattcctggacacatacaccctcccaagaataaaccaggaagaagctgaatctctgaatagaccaataatcagttctgaaattgaggcaataatagcctaccaaccaaaaagtccaggaccagatggaatcacagtgcaattctaacagaggtacaaacagcaaagacgatctggtaccattccttctgaaactattccaatcaatagaaaaagagggaatcctccctaactcattttatgaggccagcatcatcctgataccaaagtctggcagagacacaacaaaaaaagacaattttagaccaatatccctgatggacactgctatgaaaatcctcaataaaatactggcaaaccaaatccagcagcacatcaaaaagcttatccaacacaatcaagttggcttcatccctgggatgcaaggctggttcaacatatgcaaactgataaatataatccatcgcataaacagaaccaaggacaaaaaccacatgattatctcaatagatgcagaaaaggccttcaacaaaattcaacagctcttcatgttaaaaactctcaataaactaggtattgatagaatgtatctcaaaataataagagctatttatgacaaactcacagccaatatcatactgaatgggcaaaaactagaagcattccctttgaaaactggcacaagacaaggatgccctccctcaccactcctcttcagcatagtattggaagttctggtcagggcaatcagagaagagaaagaaataaagggtatctaattaggaaaagaggaagtcaaattgtcccggtttgcaggtgacatgattgtatatttcgaaaaccccattgtgtcagcccaaaatctccttaataggcaacttcagcatagtctcaggatacaaaatcaatgtgcaaaaatcacaaacattcctatacaccaataacggacagagagccaaatcattagtgaacttccattcataattgctagaaaaaaaataaaatacctaggaatccaatttacaagggatgtgaaggacctcttcaaggagaactacaaaccactgctcaacaaaataaaagaggagacaaacagacggaagaacattccatgctcatggataggaagaatcaatattgtaaaaatggccatactgcccaaggtaatttatagattcaatgccatccccatcaagctaccaatgactttcttcaaagaactggaaaaaactaaagttcacatagaaccaaaaaagagcccgcaaagccactacgatcctaagcaaaaagaacaaagctagaggcatcatgctacctgacttcaaggctacagtaaccaaaacagcctggtactagtaccagcacagatacacagaccaatggaacacaacagaggcctcagaaataacaccacacatctacaaccatctgatctttgacaaacctgacaaaaacaagaaatggtgaaaggattccctatttaataaacagtgctgggaaaactggctagtcacatgcagaaagctgacactggatcccttccttacaccttgtacaaaaattaactcaagatggattaaagacttaaatgttagacctaaaaccgtcaaaaccctagaagaaaacctaggcaataccattcaggacataggcatgggaaaagacttcatgactaaaacaccaaagcaatggcaacaaaagccaacatagacaaatgggatttaattagactaaagagcttctgcacagcaaaagaaactatcatcagagtgaacaggcaacctacagaatgggagaaaattttttcaatctacccatctgacacagggctaatatccagaatctacaaagaacttaaatttacaagaaaaaaacaaccccaacaaaaagtgggcaaagaatgaacagacacttctcaaaagaagacatttatgcagccaacagacacctgaaaaaatgctcatcaccaccggtcatcagagaaatccaaatcaaaaccacaatgagataccatctcacaccagttagaatggcgatgattaaaaagtcaggaaacaacaggtgctggagaggatgtggagaaataggaacacttttacactgttggtgggactgtaaactagttcaaccattgtggaagtcagcgtggcgattcctcagggatctagaactagaaataccatttgacccagccaccccattactgggtatatacccaaaggattataaaacatgctgctataaagacacatgcacacgtatgtttatcgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacgaaaaaccaaacaccacatgttctcactcataggtgggaattgaacaatgagaacacatggacacaggaaggggaacatcacacaccggggcctggtgtggggtgggggaagggggtagggatagcattaggagatatacctaatgttaaatgagtagttaatgggtgcagcacaccaacatggcacatgtatacatatgtaacaaacctgcacgttgtgcacatgtaccctaaaacttaaagtataattttaaaaaagacaaaaataacaaatgccagcaaggatgtggagaaaaggaaagtcttgtatatggctggtgggaatgtaaactaatacaaccactatggaaaacagtgtatgtggatttctcaaaaaactgaaaatagaactaccatttgatcaagcaatcccactattggttatctatccaaagcaaaagaaatcaatatatcaaagggatacctgcactagcatatttattgtagcactattcacaatagcaaagatacagaatcaaccaaagtgcccctcaacacacacacacacacacacacacacgtgcgtacccaacggaatattatttagccatagaaaagaaatgaatcatgtcatttgcagcaacgtagatgggactggaagtcattacaagtaaaataagccaggcataagaagacaaatattgcatgttctcatatgtgggatctaaaaaatatgaacacatagcggtaatgtaaaatagatcagagacactgggacaggtgagtgggggtgaagggagaggatgaagagaggtaggttaaaggatacctatagtaagatagaaggaataaattcattgtttgatagtagcttcggatgactatacttaacaaaaatgtactgtacttaagtgatggacacctttaatatccagacttgattaccacattatattcatgtaacacaacatctcatttacccccataaatatgtgcaaataaaaaatgcatttgtatgtattgggattatatttagtgttatatattctgttatatcaggacttgatgctttctatttgacatgctttattttaccttctattttctcctttcttgcctcttagttctagttgattaaagtatgttgttattgttgctcattttataatgcagttactgccttctattggtttggaagttgcacactgtatttttttgtttattcatggtattttatcatgcatatttaacaacttcacctttaaaattaatcaatatcttaaacctcccccaaaacaatacaatgaccttacaacactaaatctaatcactcttctccagaagtttgtcataaattattttataccaaaaaaatgatttctcaattaactcaatattaaattgtgagttaatttttgtggaagttgtaagttcagtgttaggactctttttttttttttttttacatgtgaatatctagtttttccagcatgatttgttgaaaagacaatcctttctccactatgtgcttttgctcctttatcagggatcagttgactacatttgtgtgaatgtatttcttggttctcttctctatttcacttatttttctgtattttttttttgccagtaccatactatcttaattactgtagctttacagtaactcttcaaattggatagtatcagtcctcctcttttgttcttttccttcaatattgtgttggctattctaggtcttttgcctttccatataaactttataattagtttgttaatatctacaaaataacttactaggattttgattgggattgcattgaatctacatattaacttgggaagaaatgacatcttaataattgaggcttcctatcgatagtgtatctctccatttatttacatctcctttgatttctttcatcgaagttttgtggtttcccttataaatgtacatattttattatatttattcctaagcatttcagtggtaatgtaaatgataccgtgtttttaatttcaaattccaaatgttcatcaccagtatataagaaatcaaatgacttttgtagattaacatagaatcctgcaaatttatagtaatcccgtcagttctagatgtttttttcttttttggagggggattgattcttaaggattttctacatagaaaattatgttatctgtgaaaaaagacatttttccttcccagtctgtatacattttcttttcttactgcattaactagaacttctagtataatcttgaatagcagcagcaagagggggtagcctgtcttgatcccagtcatagtgggaaagcatctagtttctcaccattaaatattatgttagctataggttttatgtagatgtttttcatcaggttgaggagattctcctctattcataatttttgagagtcttccttctttatatgatgaatgggtgctgaattttgtcaaatactctttctgcatgtacagacatgatctcctgattttttctttgtcagcccattgataagacagactacattaattgaattttgaatgccaaatcagccttgtatgcctgaaataaatcctgcttggttatggtgtataattctttttatacattggtggactcaatttgctaatattttgttgtggatttttgcatctatgttcatgagaggtaatagtttgtagtattccattctcgtaatctctttatctggttttgatattagggtaacgatggcctcataaaatgagttagtgctccctctgcttcaactttctggaagagactgtagataattggtatgtttgtttggtagaagtcaccagtgaaaccatctggacttagtgctttcttttttgaaaggttattaattattgattcaatttcttgaacagatacaggcctattcatacatatttctctttgagttttggtagaatgcatctttcaatgaattggcccatttcacctaaattatcaaatttgtgggcaaagagttgtgtataatatttctgtattattcttctactgtccgtggcagtagtagcaatagtccctctttcatttctgatattagtaatttgtgtcttctctttttcttttagttagccaggctacatgtttagcaattttattaatttttttcaaagaaccagtctacagttttattgtctttattgttttcattttcaatttaatcgatctgtgctataatttttgttatttttttgtttctgtttacattactcttctttttctagtttcctaaaaaagcttagactatttcttatttttaaatatatgcattcagtgtgatacatttctatctaaatactgctttagcagcatcccacaaattttttaagttgtattttcatttagttcaaaatatttcttaatttctcttgagacttactctttaactcatgtgttattcagaagtgtgttctttaatttccaaatatttttggtttttccagctatctttctgttttagtttaattccactgtaatctgagaatatcttttttgcataatttctacttttttaaacttgttaaagtgtgatttataccccagaatgtggtctatcttgctgaatgctttgtgagagcttgagaaaaatgtgcattttgctgatgctggacatagatttattttactagtcccagaactggtattggcattcacctctagagtaaacccagcttttgcattttcctttagctccctatcaatttccagatcactgttcttttaattaatcaatacattaaaaaataatgtatgcaaggatagctcttactacttctatttaatagtgtaataacatttgctattataatatgaaataaataggaggccaaagttttaaaataaaagaagtaatagtatatttttagatgacattattgtctatgtagaaattccttaaaaaatctacaaaaattgctagaagtacaaatttagcacaaagtcccaggatacaagatcaatatataatcaatacactatcaacaaatcactggaaaataaaatttaattatgcacacacatatacacacaaacacatattcatgttcatacacatatttatccaagatctagatgcataatgacagaaagacactgggcagcaacttttggcagcaactattaaccttttaaaatacataaatttaaaaaataatagtctaaagaaatgtctaaagaagagttatggctcttagttgaaatgcaaccactttttaacattaagggacctgcgcaactccctcccacatcctcccgtcaaacaggttgatataacatgaacagcaccagttggaactaagaaggaaaagaatacctgagcagaaatttgacttcacagaagacactgcaaaatatatactaaaggcctcttctgagcatgaaattgtaagtacgactgaaaatccacagaagacgtgtactctggagcttataataatgcttcaatgacaagattactctaaggaaagttaaataacgtaagacactgtgatttagtgccaagatggatagtatagataagcagtgaaggagtttgcttcagagaaaagagaaatctgtgtggctgacatgttagaataacactttggggaaataagaaataattaggaagtatgacctggagtagggaatggggaagtacaagaaagaaactctatcctcagtagaattattcagccggcctgatcagcccttctttaactttagctcctctcagaagattatctgataccccgatttaagaagtgtaacaaagaagaaagaaatggacatttagcttttctccccttctaccaaaagctcaaatgatgaaggtgccccttggattcttaacaacagcctctaccacagcactgtcctcaaagtaagtagaatatgtatttaagcagcaaggcccccaaatcacaaagaatgagagtaaataaatcagaaaactcatataggtagtagacagagtcatagaaagaagacctcagaaaagagaaaaaaagaattatgagaaaagagaaagaatttttaaggtatgttataaattaaccacacatttaggaaggacagttaaaaaatggagtgaaaaatactgtagaggaaacaggaagaagagacttttaaaagccaaggaaaataaatactgacagggctaagagaaagaagtggaactcatctcccatgaaacttcaaaatttaggcattcaatacttaaactattcaatgttgaataactagctttattttttttcatcatgaaagtattgttagaaaaaccattaaagcaagaccagcctgaaaacatggacagcccatgacatgaagaaataaatgtgatattcacattcttgtgcatcataattctatttgcagacctagattatgcttttggttttggtcaatttctgcatttagctagtatcccacataattcagaagaaattgtactgtctggaagtgtgcaattccttgggtagcatcatccctatatgtgtacttaagccaaaaggttctaagaagccatgcaaattaaagcagaaataaagataagaggtccctggcaaccagcagtctttgatccacctagacaatgtataaaaaggactttgatatcagttgaactcaaaaagacacactttgtgttttttttagtaacacacatcgtaatctatctcccttgagattaatgtgtctctgtccaagtttgctaacatctgttaaactcagttttcccccgtggggccttccccttctttttttctctatcttcctgcctcttgaaatctacatctctgaaatcatgggatatgtctcttaagctatgggtttccctggtctcttcctactaacaccctcttcccctccctccctacttccttcccttcctttcttatctctttcaacagtatttactcagtgtcttctctattctaggcattgtatttgctggagtctccttaaatttctgtattttctttcttctccaggccaagtaaattatgtctttcagtctaagtatcttcctatctctaggagatgatccaaggagtcaaatagccttatcccagggataaggatatttctgtgccagtcatcccaagagacagaggccactgctttcatgtacagcataaaaacacacccaaataatttttaagggaaaataaatggctcccatgagtgatccatttgtagaaaacagacttggctaaaacagacccagttacgtgtaatcagggtacctacctattctactgtcccagaattcccatatctgtctcttgacatctgttttaggaaaaacagtaagaaacaactaactggtctgatcagccttgacagaggcaagctgaatcacagcatgtgttcctctgctgaagcaacatgacattaaagccaaatacacaccaatgtcagttgtgacacagtcccaaattggaagaaattaaacttgccatcaatattgtggtagaaggcaatgggaattgctactggtaatggttaatgttcatttcttcctgttccactttctataaacaaggtaatgcctatacaagctcattactgtaaactgagcacatttaaattggcagtaaaaccagagtatttactctagtgcacatataaagtgcctcatccaatgttttggaaacgtttcaagttttgaaaccaagcagctggcagctttacaagccaaaccttacacttaaatcattcactctggaaagttttttggtgtcctgtgtcaggtagtaccattcagcagacattcattcccccaccccttgaattcttttgcaataagtttgcattcatggggctcttataactcttccagcaccacagactccaatggctgttgattaaatgtatatatcctgtgcatttaatctgactttcattatggccacttcataaaaccgccacagactggacaagcgatgacacatagcaagaacctggaatccctgcaaagtctcagattagttttttttttctccttctttattaatagtgaccattctgtggcctagctctaaatcagcaaaagtatttgacagcaaatgttcctatctatggattatatataacccgtcctaaacaccagatgaaaaagggataaccccgggaaaggaagggcttgcttccatgtaaatcatgttacaaattggacaacacccagagagttcattgttcaacctcaattgtgaaggccattcccatttactatccccctggaatcgatgttaattaaggcaggctgagaccataaatcagcttgggagttttacaatgtaattcagcattaagcatatatatttaaataaaaagtaactgattaaccactagagtttttccagaagttgctgaggccatttctttataatagagacatgtcacctttcatttttgtgaagagaggaaagaaatattgtcttctaaaaaggtgagttagggctagttaagtgactcacaacattgattattaagaggaagggaggagctgaaaagagaaaagaagagaacaaaaagggaggggagtcacatgcaaaaggagaggaagttggcatgtttgtcctagctccctagaagtcattaattcttcctttatttgcaatcatttcttagtcacctattatatggtaggcactgtgctaggcattggaagatataaaaaagtaaatgataatcagccccctgcccttgaaataagtgttcagtactgtggtgggggaaatcaacagtcacggttctaataataaaatttgggaacaacattcacaagcacttattgaatacctactatgaatatgctccaaagataatatattttatattctaattgtataaaatatcagagaggcaatttgtgtgtcttaaagaattccagccaaagcaaccacacctgcctgacagaagccaacagaacacctctctgcatattctgacgaagtggccttcatcaaagaaagcactggctctctgaatccacagctgaagaggcagaattgtttgataagtacattctttctcaagagctgtgctaatagaacacgtttactcaggtccaactatacgatgaatcataaaacaacctgcagacagataatctagggagcagaatttcctctaacccaaagtacatggataacacacattcagtaagtaattcagatacaacgaacgttatgaggggcccactatgtactgtgaactttcaccatttcatttcatctagataacaaatctacgatgtaggcattatttcctgtctaaaggaataagctaaagtttatgatgtaaatccaagttcacaccacaaataattgacagggcaaaaaacttgaacctttcctctcaacatctatggctgttccccgtctcctctgctaagatgtaactttaaattaaagatctatattctattaggccaaaggtagtagaaataatataaataagaaacttactataaagtcagaattgaaaaccaaattgagcaagagaataataataaatgttaacatttgcgtgcttactatttacaggctctagacactttttacacatattaactcatttaatcttcacatccaccatatgaagtaggcagtcatgtttgtcctgtttatagattaggaaagtcaggcacaaaaactaaaatgaacttccccccagttaggaacacagtagaggagggttcaaaatctaaatagtctagcaccttaacctcagtcctagatactagtatgtgaaacagggtggtgccctggagcaacttccttcatgccgcatgaccttcaagtggccatctgtaccatttcaaaataaattaatcaaatgtgtttctttccaaagggttagattcctttataatctgatcccaaacaatctctccagtctcatctctggacactcatcaccaagtatctatgcctgcataacatttatacaacaccaccatttatgtaaataaaacatatagagaaaaaataacactgtgttttccatcaataatatgtccatatctaaatatagattggagtgaaaacctgtgggggaaaccagagaatttgcacagaccagtgtgttacatgcgccataaaatgaggagcatgataacttaaaatctgtggatctaagtctctccctcgcttagttcattcaagcttctataacaaaataccatcaactttgtggcttacaaacaacagaaacttatttctcatagtcctggaagccgggaatttctagatcaaggcactggcagattcagtgtctggtgagggcccactttttggttcatagatggtgcattcttgccatttcctcacatggtagaatggacaagctagctctctcaggcctcttttacaaggacactaatcccactcatgagggctctgccctcatgacctaatcaattcccaaagttctcatctcctaatactatcacctttgtataggagtcctcctttatccatgggggatatgttccaaaactcccagtggatgcctgaaaccgcagacagtaacaaactactggtatagtaatacatactatgtttttctcctatacatacatacctaggatcaagtttagtttgtaaataggaacagtaagagattaacaactagtaatgaagtgaactccaacaccatatcgtagtaagttatgtaaacgtgatgtctctcaaaatatcttaccatactgtactcacctgactgtggaaagcaaaaccatgaatggggtggagggactactgtattaggatttgaacatatgatttttggcgagacacaaacattcagactgtagaagtcccaaccccctctcaaatcctatattaaaactaccaatttctaaacatgacatgaacttttgtgagtcaggatatttgaacatactgtttcctgccttctttaattgacaggacagtaaaatcttagtcatctttcaaaactgagttcatatacgacctcttgataaagccttcctaaatcccttcatacagagctaactgcaggtcctctgacatatacctacctatcatactgtcctgtaatactttacctaaaccctccactgtattgcttgctccttaagaacaaatactatgccactacgtcatctttacttttgtataaccaacatctacataaggaacagtaaaatagtagatgcccaataaatgtttcctaagtattgatattacataagaagcaagtatgaattaaaaacgtacattgtttcttccagctaaaagcaaaacaatgtatgttttggattccaggagtcaagtttcttgaaatcctagaatcactttcatctcatgtcccagaaaagctgtctctcaatctacagtgaataccatctcatttatattgtaggcttcctacatttttcttgtctgaattgaagttaagacaaatagttttcatccagaacatgattctagataaagacactgtggtcaccaagactatggacgtatttactaaaataccagtgccactggtatcctgctaaagcccttgcaaatgaaggtggttcacaaggaactgcttttctctggggcactggatcataacactggagttctcctgagtgacttgaagtctgaaaggccaaattgaattgcagtcttctcacctggccactatcaatgatgtcattttatagtttgttatttaaactgactgtgcattaggggcttatttataaggggatacccttataaaagtcttattttcttctacagcacaggaggaggaggaaaaggaagaggtgaagttgcttgtgttttagtcctggtttcatgctaagtatgtggcaagtcactcagcttctctagccctcaatttctttgtctatgagggtaccagacctggtgactgaaggaaggctaaccatggcacttatgatacaaatcttgtttccaggctcttgacaaacattaataatgaatcatgacactttccagctagacttttctgaatacttttcaatacggcacttcagaaagctactatcaatctaatggaagatgtcatttgttattaaatctattgccatcccttacaacccttgagttctaatattctgtacatctgggttagtggatatagaacacatgtggccaccagtgggcgctcaataagaaagtgtatcagaagttctgtgataacataggtttgatttgttccttctctaaagagtgtatgttaacatttcatagccatttgaataacagaatctccatgactgctgcagagtatgccctctgtgttctcaaatgtgactgccttcttttccaattatgtctaatattttaacacacaatgaatatactacaaagacatcatttgaaacggtgagattcaggtggaaaagagtcctacaacagacatttttaaacctatgccaagtcatcaccaagaacagctggaaaccctccctccctgccaaaaaacggtttttgtttcctgttgtgaaattattcagtacaccaagatcatactttaacagccaagtcctattaaagcactattttaaaatgctctaatgaatgagaatctttttctcggtctaaacatagtagaggctcctttggttaggaagagacagattcacagagctgtacagggtcttagatataatctctgcaaatccaagtgttagataaataaacttgtcaaaagaagtccaatggcttgaccaaggccacataccccggatttgtggcagaataaagaacgaaccccccatatcctgattcccacctcagtgctttttctaaacttaatttttgctgatgtctatttgaaaagaggacttgatggctgaccagatccgagtgatctttgctgcatctctatcatgatgcttcttttttatttaagttctgggatacatgtatagaatgtgtgcgtttgttacctaggtatacatgtgccatggtggtttgctgcacctatcaacctgtcatctaggttttaaaccctgtgcacattaggtatttgtcctaatgctctccctctcctgcccccacccaccgacatgccccagtgtgtgatgttcccctccctgtgtccacgggttctcattgttcaactcccatttatgagtgagaacatccagtgtgtggttttctattcctgtatcatgatgcttcttagacactgttcagcacaaggaattctgtttgagtccttttacttcagcacaatcaacacaggtgccagtaaaataatttttcattttctttcccgaaagcaaaatatgttagggaaactgttgatttatattcctaatgaaacactacttagagatgaggtcctgggacactgtctgcagtcttcccaggtgcagaagcagaaacttctgccagaggacagtcaacaaccagactattacaatcctcaaatagaaaattattttcctaggcatattaaggaatagctttgtgctcttccaaccaacaggactaaatttgaggattcaggaagaggacctcaaaaccaatccttatcataattacttcccagaggagggccggttttggatgagcagagggaaaagggaatggccaagctaactgatttaggagctggttacaatttcatggcaacaaagtgagtcctttttcatatgttcccttctctgtagaatctcggtatcccagactgaaaaagaaaagcatatcaaatgccaaagtctttataaaatggtcactgctcaaagggctaatatccagaatctacaaacaacttcaacaaatctacaagaaaaaaacaaacaaccccattaaaaagtgggcaaagcatatgaacagagacttctcgaaagaagacatttatgcagccaacaaacatatgaaaaaatgctcatcattggtcattagagaaatgcaaatcaaagccacagagagatactatctcacaccagttagaacggcaatcattaaaaagtcaggaaacaatagatgctggagaggaggtggagaaacaggagcacttttacactgttggttggagtgtaaattagttcaaccactgtgggagacagtgtgtcgactcctcaaggatctagaactagaaataccgtttcacccagtgatcccattactgggtatatacccaaaggattataaatcatgctactataaagacacacgcacacgtatgtttattgcggcactattcacaatagcaaagacttggaaccaacccaaatgtccatcaatgatagactggataaagaaaatgtgaaacatatacaccatggaatactatgcagccataaaaaaggatgagttcatgtcctttgcagggacatggatgaagctggaaaccatcaatctcagcaaactaacacaagaacagaaaaccaaacaccgcatattctcactcataagcaggaactgaacaatgagaacacgtggacacaggatggggaacaccacacacccggacctgtcaggggatggggggctaagtatggtacgtgtatacctatgtaacaaaaatgcatgttctgcacgtgtaccctagaacttaaagtataattaaaaaagaatatggtcactgctgtttggcccacaatttcttcttccacctaagggaattaaaataaaaattcataatggtactttattagagacactccacacatgcatttgaaaaaaatctgttaagtacaatttccttttgtcaatatttcaaagcgtcttagattctgggcaccatggcaggaaatgtcatatattttcttatctcagcaatttcaccttcctagtagaatgcttttaagaactctaataaggacaatactccctgcaacaaaggctttctgccaataagaaatgtcccttcccaaaccacaaaggaatagatatctcacggtctccaaggaaggtagtctgacatgtgaatggtgcagatggttgtattcctgtgttaaaacagtaaagatcataaagtttggctttttgaaagccaattaaaagtgactacgctggtttatacaattttacttttcaaaagagagcatcaggatagcaaggtaacaagcaagtctgttcccccaagacaggtgtagagttgcttaatttattcatgcttgatggttgaatgttacaagggtcatatctatgtatgtaaaacaaagtaaagaaaaatcaagaaattcgttaaagattgaggtgattaatcttgtatgtattccttcatcttcctcatagaacaacctagaatgggggaggtagagttgaaagatctccattttaatgccagtctgccttttgccacttgtgtaaatcctgagcaagctattaaactctctgagctttgtttcctcctccgtaaaaacagaaataagacctgtctgccttacagagctattgcacaattagtgagataaaatgtgaaatgtgcctgaagtatagctggttaaaatgggagtttctctcttccctaagttcttgaagaaaggtctgctggcttcatttggtttcccccacatcttaacagcacttaaaatgcagtaggtgctcaaaggatatagtaaatcatgtttctagaaaaagtagtggggctgggataaggaattaagattggctgtcaacagcatcggattcttctaaaagttgctttaagttgctgtatacatctcaacagttagctggataaagattcaaaacagtgaaacttactagccatacagcctgccttgcttggccacttttgcaacaggaaaacaagagaggacaaactaggcttatcgcacttgtcagcccacagcaaaatggccataactatataggcaggctgccatggattttctaattggggaatctaaagcctgaggaattctcaaagcagcaggtattgataggagttaggtgtaaataatttcctatcctcagtgaatctttgacataaagctgccatgttttatttcagtaataaaacgttttgtttttttaatagtaaatgcttcaaatgatttgtattaaactctgcagtagattgtaccttggagagttaaattttactcaacttgccattaaactgttttcattcctcataagagagtaccagacagcaaatcaatatccagattgatttatatgaaaaagtttagttaaacaatataaggaagtagtttgaggacttaatggtagttatctccttttacatgattgtcccactgtttctactttaaagagatttaagaacaaccaaaaaaatggcagcgctatcatttacctataaaaaactgtattgatgatcatctcagtatggcactctgtaaggctggtgtcctttaaacattataatcaaaggtaatatttttaactttgaaaaaaattagccccaactttttttacttctaattaagagtctacctatacagagtaaaacaataaggcaagtgctcagatcatttagagagggggaaaaaacttcttcctgaaatggttatatagttagaacaagagtggttctgttgacttccattattcattcgctttgcttcacgccaaaacatctggctaaaaagtgaaaaaaacacccaaatggcattgtatagaaaaaacacctagatgattgattgcatttttcactttaaagtcaatgttttgatattatagggacatgggctttgttcagtaagtgtaatattttactagcaaaaagcatggttttagaaagcttgctttgagaaggactaatttatcaattataattttaaatcaattaacagttttaaataatggacccaatattgcaggccctgaaccccacttatgctgagtcctaagctgaaagtcaggaaaaaggaaaagtcttcactagaaaaggctgctaactagactgctcaagtattcagacagtacaaggtcaaaaaaaatgtaaaactaaaggtaacattttaaaacagctttaaaatactaatagaaagtgattgtgccagagtaagcagctgggtattttaaattaagtgttgtatgcccaacacattgtactgatgttcaatgattacacaaactgtgttaatgctgtaaatggaaataacttaggacattaacagttaggtagccaagatccacctagcttctcacatatccatctaacctcaaggtctgcttctgaaagtgaaaggacacagatgagactacagagacaaaaggtcactagtcgtgttccccagaggacagtttggtcagcctttgatggacaaggccggatccaaatgaattgagaagggaagtatggatgggggatctgcccctttcccagaatgatgctgcttgagatattcagtgttattttgggtcattcagattaaagggtccaggggaattacggtgacctatgatgcagacctagtgttccatttgactcaggattccatgggttacagcaggatactcccacaacagatctaaaatgtccaattttcccagtctcccttaatcaaatgacaggtatgactaacacctgagctgagtctcatggaggtcttcttggactctattttttaaatgtttaaaatcttaatactctgttaaggtataataataagctgtatgtatctgatgagttttagcatatgtacacccatccccacagtcaagataatgaatatatccattccccaccccaccccacaaatttccttgtttccctttgtaatccctccctcttacccaccctgaccctcacattccaaacaaccactgatctgctttctggcactatagattattttgccttttctagaatttcatatgaatggaatcacatagtaagtacccttttctgttctttcactcagcgtattttacaatttatccatgttgttgaatgtatcttgtggtttggttcttttcactgctgaagagtattccatgttaggaatataccaaatcttctttaaccacagaaatttgatgaaggtgtcctaagatccagttgtgcctctattcctctcgcatgatttctttatgggtcatattcctacgtgtacaaagattgctagatggtgtgacttagatgtgtcatttaaactttctgtggctcaattttctcatttgtacaataagataataaaaaccatttattgagtggttgtaaggattaaataagatattggattactgaaaagcctaacatagtatgcactgagactttttattcattctgattctgaatataagcaatcaattcaaggcaatttatgagtactcttaaaaagctagtcactccttgttctgtctgagtattcgttcacttactctctgttgctactaagaccactttgctaaaccagcagagacagatagggtggggaaagaggtaaagatggtgaaggccatccaacacattaactggtctccccaaatgtctgatcactacccacttctgacactgccatagagacaggctaatgcaggctggttcaaacatggtaaggctacctggcctgtagagggtctgaacagcggtgtgggaaatgtactttgagagaagaaaactcaagagaaatggcttttatgtacccccctgtcttgaaaactgagaatgtaacatgatttctttttgtcttctgtttggaaacaaatgttcctctgcctatcttccctaggttcaattagtcttctgtctttctcagaattcagcctgttcatttgcaaatggaagacttcagaaaggctagtgggtgtgagtgtgggtcttgagggggaagggggctgaagtgtttattttcaaagccacgggggtccccatttgaaaaagcacccagcttatctcaatgtttttgtttgtatgattttgaattagaaggttggagcaattcatttaggagattaagctgtttttacaatgggcttagttgccctatttattcaatagtattgctagggttaaaaaaaaaaagtctttctactgtgctcttcattattccagtgtaccagttttaaagaattccttggtttttgcttttaatgccagttaattttacattaaaatgatgtttattaactggtcacagataaaaatcaccaatgatttctctaacagtttagagctgcccgttttagcaaataaaagtataattaaatatgaatttcagaaaaacagtaaataaaatttcagtttaagtatgggaaatcatagggtatactgatactaaaaaactaattcattatttacttaatcttcaaatttcactaaaaatcatttattttatctgacaatcccaccatgttttcatggatgttgtatgtgttccaagaatggtaagtgaaaactaagacaaattccatttcattattgcacttagacttgctccctgcacaggcaaagtacttcatcaaccggaatattaatttccagtttataaacagataaagtgataattcaacaaatcaagtgaatttgatacacaggttaagacctagttctagtcactaaagcctatttcaactaaggaaatttttctcatcacaaaaaaagtaaaaccaaaagtagcaactagcatcttcagttgaattagaagttaatgtctcaaaccactatgtttaaatgtgaatatcatctttcatttatgctgcaaagcaaacatctatgcaaggaagggctcgaacacctcaatgcatatcctaaggttgaagaaggctttgaaccaataaatgagtgatttctccacaggagactaaacatttgcttgtgacggtaaacaaaatgctgaattttatgtagcacaatcatttttacatatctgttgatataagtagttaaagaagaattattgaatttttttctgtcaaatgaaaaggtttgcacttgactcagatcttagcaaataatcgtatttaaagaattaaattattccttaaatgtgatgcttcctcttaccccaggaactggattataatattatttgcagtaagtcattcctaaaggaccctgacttaaactgtgatgataaactaataagcctaattgtgcataatttatagagttcattttaaaatcacatctaacattttgagaaatttttgtacatcttaaacttaattttctctttttatttatttatttttttagataggcaacttcccagaaaagaaaaaaagaggaaaggagacaaatgaaaagctcaaatttggtcaagatccctatttgccatttaaacacaacattagaaaactcttgctaggactacattttgaaataaacctcatgttggaggtcagttctgctaagaaataccactgaaagctgccacttgacccggaattcctctacaagaaaaactagccataactacatgagaggcctatatgagaaactgccagaatgtcaacttcatttgcagtggccccatatggcctgatcactctccctggcatgataaatcactggcagaattcttaccttcctacgtttgatctctgctcagcaagatgtggttttgatgtgaagaactccagatctcttaggtcagagacaaatagcagtggcactgacctgcaaagtgctaagtctctattagactcaagtgaaaagctgtaagcttctgacaagttcccttgccaccacgcttcctcaccctccatggttttcatgagcttagcttggcaggaaagctgctcaaatggtctggaggagaaatgacaacaaatattttctgcctactactattacaaagtattaaaatcaattttcaccaagactcaaaggaggaagtctcttgggagtcactgctctaatttctaatatggtaagtccttagcaaatatgaaacattttgatttccgctggatctttatgacactgctagccactcatttatataacgagaatcattaacagggatttctgtggactactctttggtaaccatgagtacattgttgagacagtattttcaacaaaactgtttgagtgcaaattttcggccctaaaaagaccacaactaaatatgcaagcagttcagtattgtctttcagatgcccataatcccaagttctgggcccaggaaagtagagttctaattagtcagggtggggtaaagaaatcttatagcttttctaatccaacacttttaaaaagtaggtggattaattaataagcatctcattctggtctctcattttgtaagtaacaaagctgttaccaggatttattttttattttttttattttttgagagggagtcttgctctgtcgcccaggctgcagtgcagtggcgcaatctcggctcagtgcaacctctgcttcctgttaccaggaaatttaagtggcgtacccagtatcacaaagcattttcatatttccaggtcccattatagaatagataataaatgatcaagttattttgttcattcgctaattcaataagtatttattcaatgcctgcatatccaagaaactgttaaatgaacatacataagtgacagagctggggtcagaacacgggtcttctaatgccctgtccagtgccttgttcactgctctgcaaggtacactgaaaggtttctatttcagaggaaggggtaaatgcgtggcaatgaagcagaagagttttccaaagtggatgtgtgtataccttctttaaaggaagcacatgaaagaaatttgtttcaaaacactttaccttggaattcactttctagtcctggcattttaactattaatgactctgcaaatgaaatcagacaatttattgtctaggatgtattcatttattcattcatcaaacacgaagatgtatggaccacactctgtgtcaaggcagccatgataccggctctcataaaaatttaagtccaagaaaaaaatgagtctacaaattaaacagtaattggatcccttggagtgacattataaaacacacagtacttaacagtaataataaagttcgaaataaacctaaaatgccacatttaaaatgcttcttctaagagatttttgtgttctgaagtcatgtgtgcctatcactgaaaatgacagcagaaatactccaaaaattgtaaaactaaaattggtgtggaattttagttcactgaaattataaagtgttccaaaaaagcaaaaagcatgctatcattttaacagctgcattatttcaacagttgtcccctttacaccactcacaattacagacactcacaaataaggccctcatctccgtagcaataagttagtgactttgcaagcattcagtgaaagcaaaatgtttggtttgttttttggctaagtgtactttatgtacccctatttatgcatacatgcctatactaaatgctgagcaatcatctttctccttaaatcagatcatcaggagttccaaaaatcactgttttgtgtacttcttttctacgccctctctttttctctgttggaattcctggtaatgataccagaatgtgggcaaacctcattagtctccctgctgtttacaagacaggatttatgctcaatgtgctgaacacaatgacacacatcactaaatagctacaactaccacccaggctttaatctcagaaatttttcactcagtacaaatacctatcagcatggagaaacatggaagagcaattacagccaacacgtgtagtcttttaagagtacaccaataaatacccatttgtgaaggttaatttaatgcaacccaggctgttatctggaatagtatatgtcgccaattcaatccattaagtaattactaaattctcaggagggctcccagaagtcaaatgtggttattccaggttcattgcttctggtctcccaaaggaccatttaggccaacagctgggagagccaactacaaaggttcccaggcataactaaccatttcatgcaaacaggtaaatgagtctaaacgagaaataagagttatcaagtgcctgtcctaagagaaacaccaagggaagcagaagagaagcacaaaaggggaggaataaaaaaggaaagaaaaggcataagtttggtaagtaaaaaagatctgttctctctaaaagtgaagtcagagaaatctggagattgcaagatctggcttaaaggacacaacctttcagcagtttctttagagaggatttttcaatcatttataatgaaacattaattgtgcaccccaaatgccacccctttgtgttgctgaaactcaaagtttgagtactgcatgaattcctctattctgcctccccactgagattacaggtaacagagggatctgatagtaattaagccttagtaagatgattgctcataagagacaagatggaacatacccacccaactctttctggcaagcatctctctcacagaaattatagcccagttacacaaaatgatggcccactggggcacagaaagcattagaaagaatgtaaaatatattatcctcaatagcctcacacatcctccctcccaagtcaatcttaacagccataaaaaaagaaaacactttttgaatgcaaacaaaacagatcaaataaacaggtgttattaagggcagtgtgtgactacacaaccaatgaggattgaaaaacatcgttctttatcataacctaaaaaatcacatattcccaggtgatgtatacctaaagtgtcaaattgtatcaattctctcctttttttaaattcatactcccatttttgtctggttggaattgttgcttatgatagctgcggacaatactgagtggaattagacttaggatctgaatgaaatatgggatttgtagttgaggaactgggcttggggtttcctatgaaacattcagcaaggctttaggttaatagtccaaattgtattgtctttgtagtggttattatgtttgtccttattgttacgagtagggaaggaggagtattgagtcctggaattgccacccactattgctgttgagcctgaaaaaactaactttaatatgcttgattttctcacttataaaatgaagatattaatacaatatccacatcgtagtgttgccccaagaatttaatgtaatcatatgtgaaaagtactctgaatattgtagtattaataataaaagccgtagctattaaaatataacaagtattcattaagaaaacattcttgaagtttctacattgttagacattgagctaggtacttcagaaacaccatgataaataagagtttataatctagtacagtttagaagtagggagttacacagaaaaatataataccatgcaaaaattgtaccactgagaagtgcaaataagtaatatgaatgctcagagaatatacattcattatcaaaaaataagtgtgtagccaaaattgtcaggtgttatatgtaagtatatacacagaaggggtagttttagttttaaggttggagaatttcacacttccacaatattttctttaaaattagagatacacatgtatgaaccaaatcactgatgaaattcaaacacaaaggtaaatatatacaccagctttgggtttagaacttaagttaaaatgttaacaaaataagaagtaatgttattttcagacctggtgcttaggaataatttaaattctcttcactaacaggatgaagtatattattcttgaataatgtagagttattcaaaaaaaaggtcttttagaaattctttttaaattatttgctacctatccatgttttctccaaatctatcagcagcacagagtgaataattcatcaatttatcttgacccttcaaaaatgagtgttgtatgtgtgtgagagacacagcgcgagcgcacatgagcaagagtacaaccacagctaatatttaagtacttattctgttccagataatgtaagaaaggtagggaaattaagtcttgacatgaataagttataataatcatgttaccctagagttttatacagtggccgcctagaggtaagtttgtggaacacagcactgttcttagtttagggaaactagtgtgtattaaaaccatcaatcaaagtagtttctcctattttcccattatagagaagaccacacattctagacttcctaatctgattccaagacttcaaggaatacaatttttaaaaattatttaaacatcaatattgtttgactttccaatgctacatcatttgtctttattattgtccccatgcataagcaatgaccaattctaggaggtaaagacagaaatgcaaaaagcaaaaataaactttctgaagactacaaaaagaatgccttgaaaaatctgcaataggaatgcatttctgaaacaggactctaaaggaaaaatccttcttcctttgcatttaaaactgtatgacagttacacaagaaaaagaagagggaaagttacaagaggaaagaaaatgtttgcatagtaaataactgataaaaattataatcctgaatacatttataaaaactgataacaaatcagtaaatacacaacatagaaaaatgagcaaatgataaattagccaaaggaggaaaaccaaacggccaacatgaaacgatgctcaatctcacaagaaatcaaggaaacacaaatcaaagtagcaatgagatgccatttcacacttaccaggttagcaaaatttaataagtatgagaatctgaagtataggtgaaaatgtagactaatgggaactctgacacactgctggtgggatatactggaggtgtacatactgggaatatactggtggtggaaactagtataactatgttggacagaaatttggcaatccctaattaagttgtagatacatatactccatgagccagcaatatcacttttaggtatacatcctagatgctctctcaccaggtatatgaggagacatgatcaggaatgtccaatgcagcattactgcaataacaaaatgctggatgcatcataaatgtcaagagcagaaactaaaaattaggatatattcaaagaatggaatactctgcaacaattacaatgaactaattataagtacatccaacaacatggatgaatactgaacatatgtttaacaagctaatcaaattacagaaggatatatatatatatatggtacatatatataaaacatttatataaaagatgttaccacgcaaaacaatagcatgtattatttatggatacatatacctatagtgaagataaatgcctctggcaaaggaagagaaagaaagaaatgggggcttcaatttattccttttaaaaaattagaagcaaatactgcaaaacattaagaactaacaaatctaggtacaggtacacacatttgttatattactgctttacttttctgtatgattaaagcaattcattttctgtcaaatatgtctggcaatagtgtgctgttcttctgctgagctggaaacatctctatcttctgaatcctcattcatctcaaacatttagcatcttctatcatgaacaatagctactgtgtgcatgaccccactccacacccaaatgggaatcctctaccgcctcttcagagcaggggccacacctatatatctttctctgccagagtgactcacaatgctttatacacaaaaggccttaataaatgttaaatacacaaatgaatacataaattcagggaggcacaagagtagctctggctacagccaaaaataaaaatgaccctgagataataaaaattaaaattaaattttataataaaattaaataatacaattatattatcaaactgtaaaacatagatgaggcagaattcaccagtttcagttttattggggattttaaccaaacagtctcacactgattcttcatcttctcccaaaaaggattctgccagcaagtccaattttcacacctagagaaataagactttcagttgttctccataaattcatacaggcatttcataatttcaccttcccaggcaaagccttcccctcctccttcccacctgaaatcgtgccactatcacacacatctcagtctggaaatctggtatatgagtgttaggagtgacaggtggggaaaaggggaagtaggttatttttgcatatctcgtgggcttgctaaataattagtgggtttcctaaactcacaatatttcgccagattcatttactgggaggtaattccattcttcttgtgggaaagagtcacacaacctataccactttctgactgtttaatctttaaggaatcactagaaatgatattcaaaaaaaaaaaaaaaaaacctaagagtcactggacttgaaattcaaagtccaatgaatagatggatgaaaataatgtaaaataaaatatattaaaatataactttttaatattttgaaaaatgtataatcaagattggaaagagttttcagattcatgatatgctaaattcttctagataagaaacaggtgtttccagtttgacctaaacaaaagcttttctctttccacagttgtagtgataaagaaatactactttggctctccaaaggtcagacagtgatgaggaagggaaacagagcaggtaactacttctggaggtaacagagctgaactggagtaaaagaaaggcttccttctataataaaaattagaaagttcacacgcagacatactaatttttaaccacattctacagaggtcaattaatccccacgtttagccccagggaagtgttgtttagagcccagcagaagtctaggtggtgaaatcacccaattattattccaactggaattttcaaagcctggaagtgttttcatcatgtgatccaacagagacttgttgtaaataaacctgctgtaaataagctctaagattttgaaggaaaacaatttaaacataactcaatcttaaaggcagacagtagagaaataccagtgataagtaattcccaatgtgcataatctcatatatttaaaaggttaaatgaaatagatctcaaagatacaattaaaggcaattaaaaattaacccaggtgacattacagcaatcacctctacgtgaattagatttgctgtttggggggaaatgaatggctttgaaattacctgtcacagtcaataaagaaattaaagaaatgctaggagggctttcaaaatagccacggcctggtgcttttactttctggaaggtgactgctcctggaaaatgctctcaaaattccatatgttatcttggacagtcaggactagtaaaagtttcttcgtttttaaattatataaagtaagataccttcccactgtcaaaaggtatctaccttctgagaatgtccttgtatgctgcatacttcccacatttatgtatcaatatcttgtatttttatcctaactacttaaaataccagaaacgtctatttgcaacctggagtttaggctcagctaatcgggcatattgaagcatattcatgctatattttggcacaaatgtcaagatatctaattttattattaaaatactgtcagagaaaatgctttagtaacttttttagtaaagacaagaccttggtggaaaaccctcccaggaatcccatttggtaaaaacgcagtgtaaatatataaggaggattccatagctacccagaatattgaactcttatgagtaatgcacataataaatgtaataaaaataattaaaagaatacataaaacagaccggttttataaaactttgttgatcatataatttttttgagatgaagtttcactcttgtcgcccaggctggagtgcaatggtatgatctgagcttattgcaacctctgcctcctgggttcaagtgattctcctgcctcagccttccaagaagctgggattacaggcgtgtaccaccacacagctaatttcatatttttagtagagatggggtttcaccatgattggccaggttggtgtcaaactcctggcttcaggtgatccacccgcctcagcctcccaaagtgctgggattacaggtgtgagccactgcgcctggccagttgatcacataattctgatcttccttaaaattggtttccattaatttagatctctaaatatatatatagtcatcactttgcaaaaatgcaatagaattttggctatcattatatgccacttactttaacacacttttcatttagtccttttaaccccataaagtagatactattatctcaatgatgacaaatgtagaaattgaaagtcagtgaagaaactctttaagatgccacacatatctttttttttttttttttttttttgtgctgttgcatccctaggacctggcatcatatcaggcactatgtgtcaaataaatgtaactgtccatgtagctgataagtacctttctgaccaggatttgatcaaaggcttattttaactcagagtctctctttttccaaatgaaggaagggcatgcaagttttttctaaaatgtgggctatatggtttctgtggctctgccattatagtcagaaagctgccgcagacagtatataattgaatgagtgcagttgtgttacaataaaactttatttataaaaccaggcagacagtccacagtttgctgacccctgatactgtcactaagataactcaagagacaaaaactcctatcagtatttgtattttattgtccaactaagaaagactcagaactgataactctgggtgatgggacttgggatatttactgattttgtcatggttaaatcattgtgcttcattgatgcaacagagaactaactatgcatgatttgcctttcttaagcctggctatgaggaagtcagacctcacaaaacagtctcctcagagaatcctctactctgaaatacaaaaactatcattcatcattttatagaaataaagaacgaggagtccctcagcaaatgataattccacatggtaacataggcccatgtagtggaagggatcagggcaggaccccaggagaattatctaattcaagtcctgtgatgaaattgtccagcttccctgtgttaaatggagatgatacaaacaccaaaaagctgcatagttatgaaaaagtatttaaaaaaaaaacctgaagtcctctattaacatgtagtttgactgacaatttatgaccaaaacagacaatcttaagtaaaggtttggaaggatctagatccacacctatcttttaagaaattattcctggcacaggcaagaatcttgccccagattaaaaaaaaaaatctcatagaaaaatcaaaaatagccatttaaagtattagaatcaaaagtcacaaaagatagctccttcttaagaggggtagactagttcatattttctccatggttgcgagagaagcaacacaaaatataaagatttaaactccttccctcaaaaaaaaaaaaaacaaaaaaaaaaaaaaaacggaacaaaacgatgaaaaaacaacgtgccacagaccgttagaaaaagtgtatggtgatgaaaactatcaatttctttaaagtcaaggccaatgtctttcttatgaattattctatttatttctactctctctccttcaaaaggttttgcaaggatcaaacaagatatatatgaaagtgctaggcagaccattaggccctataaaaatgtaagtggcattataattatcatcatcattattattacattgatcaactgaactactgctgtactaacaaccaatttttggcacacaaactttttaataagaccctaatctcccagaaggcagatgtttccagtctaacacagtgaaaagcacccctgttaggaacatggccactcaaatgccttttgaatttaattgaaatagaccccagaaaacagaagtttaaatgaataaataaaaagacaaatctagactcacgatgcacattagctctgagttttaagttgattgcctttttgcctcttctattttagcaggtcattatgttataaataccctcttcctccctgtgtttcagccccatataatatcagatgcagaaaaaaaaaacataactctttgttactgttagttatgggcataaactctcactgaaaaagtgaccaagagaaagacagcacaacgatctgggggagggaggaaggaaaggagagaccggtacagccagaagagaagatagagccaagaaagaaggtcgaagtggaatacagaggacaagtttccaaagacctgggaatctgttaagagatatcccctgcagtcaggggcggtcagtaaagtgctgagccttgactttgtaatgtgtgtattcctataatatcagttatacaaaattataaaagtcagactaataaaatagacaactcagaaaattttaaattcataaacacatcgctcaaggcaatcagaatgcagtcttcttaggatacaagcaaaggagagcgcattctcttggtaccaaattggtcccctcaatacttcatgttagttttcactcctccttgactaacaccatctagttttaaaaagcacattccttcataagggatcacttttaaaacttgggatccagcttgctgtattagggaaatacaaatagacatgttccaaaaatggtattgccattgatcattggtataatatggatactagaatttcagagtggtaagcgtattttaaaaaatggaatgtaactgcctaaaagtccatacacaaccatgagtttagccctttcaacatccttagggaatgaactttaattctggagcatttccactggacctctagcaggcaaaggcagtaacttttaattctggtcatctcccccattccctttattaaaaatgtgaaatacttctaggaggaggaggaagttggagcaaaaatacagaaaaatacaagatcacaagtacaaagttttctaagtgcacattacttgaaattctcatagtctggtcatttattttaagtagtgactctatgtgggtcccaatatcacactgaaaaatcatacagaaagtcatatccttcactaaagatgtatgtttagcaagacaaaaaacaataacatattgtcttacagtatcattttctgatgcaaatattgtgtttctttcaaatgtgatatttaacacgccctaacgcgtaatacttttgtagccattacccttttaaaatcccctatcgaatatggtatcactatgctaaaggactgtccattctatcttgttcactcttctgtttgaaattgctaatataatttccctcacttctggtcatgtttgtttttaaaaaactcactattaatcttatttttcctttaagtaaaaaaatcattaccctgggataccaaaagagcagcttctgctcttcacgtttaaaaaaaaaatactgcttgtccactatgcttgtcttagaaaatttagaagtctcactaaagagctgaggaggaaaactgctgggaatgctcacagatacctgattttacaagtttttgtggaaagagctcgcctttagattagtgttactcagtgtttatgagggttgtttgtcaaggcaaaaataaggtacctcctccccacaaattaaagaatcaagttacaatccattatttcatttctgattgtttttctttgtattaagtgggaaagtggatactggataaaagttccccgagctaaaagactccacattaaaggctccaattagctataaatcagttgtctttcctactgggggagaacaagagagaaaagagagagggggtagttagggagtaagagaactggaagagcttccaaattaaattctgaaaaacgtacctattgcatacctaaaatttctttcagaggctgttagaaaaatcccatcaaaaataagactaaaatcaaaccttcccaaatctgagggttaggtcttttctcctgtgtagatcttccattttaagacctttaaaaagagcctgaagaggttagagaccctcataaaataaaacttctaagctgcatgctttccctgctcgttcctaaacccagacaagtgccacacattggcactattgttatgcaaacaatgcctaaaaggttataaccattaacgacctctcattaaaacggctttgaaaaatttgtcacaccatctaaaaaagctagcaggtacattaaatccatctaaatcgacattcaaaacacaaatcgccctgatttgtaacctaaaactcaatgcaagtaaaatctcaatattctgatgttgtttcttgtatatctcattcaaccactaagccagatgcaaacaatttacttctctacaaaatttatcttgtaaaaaagcacgatggaatacatctttaatcaacctttaaccatatgcatgtgcgtctatgcgtttgcgttaattgggagaagttgagtgtagaaatgtaccgaaaggactagaaaatcaaaccagagaactacaaaatgaactccaagaaacgtggttttcaatcccatctctctctcaccacctccctcaaaatgttgtaacattacaatacccctacgtttgtaatcgatcattttttttctatgtcgaatttgtggaaagtaaattcattttatattaggtagcagacgcatattcttttttaggcgatgcaacaacaaaaatcctgcttagcaaacccaagatgtcaacgttcgttataaaaaaaaaaaagtaagttcttcagttcaaaaccgaacatgctaacaaatattaaaactttttaagtttcccagggaaactgccgctgcctacaaaattcacatgaaacgctgacgttggagttactgtacttatcagtcaggtttccgtgaaatttgtcaaaccggccagagcgctggtgtcttgacaattccttacgggaaagcccctcagcaccctccgggctgtggaggacctgattgggaccaacagccgaggggcccggaaggcggaggaccgagaggcgacggccaggctgcgtggccaagctgacggggaaccccggcctccatctgaggatactaagcggttccgacgccttcccccgcggcagtcgggaccgggagaatcggacagaaaccagcctcagagtccggggcaggagccgttgacggctgcccctcaacgctgcgcttcgggttgggttaagtccccaaggcgtcctcagaccacggcggggcttcaaacgccccagtcccgaagacaggcagggggtccctctgctgcgccgggatgacaggctggccccgacgaccccggccccgtcccgcagccctcacccgctgaagagatcggggaaaccgaagaaggttctagaaagtctccgtggacgacgggcgctgggcggccgcttaccttggtgtacttaatttcgagattgggcgtgggcgacggcaggaggtgcagcgacgccatgagggcggcggggtcggccttcacctcgccgggcatctctatcttgctggaagtcatggtggcgggccgggtgtccctagcccgcggcgtggggcagtgcgggctgtgcgcgcgg

SEQ ID NO: 1155 - DNA, 112280 bp, Homo sapiens; identical to SEQ ID NO: 1154

SEQ ID NO: 1156 - DNA, 60609 bp, Homo sapiens
tacacaatataaatgctttattgctagcacagaggtttctttttaagtaaattaaaagaaataaatcttcattttcacattttttgttgcagtccaaaggtaactagttggttagtggctatgtccacttggacacatgctacaggagggcagcattcacatggaagcactcagaaatacggcatctgtcagggctcacggcactgggctgctgaatgcactgtcgtttgtaaataacagcaagtggagactttaaaacatcatggatagataagagttataaatagaaaactggtacggttaagaagcagaagatcgttaaatacagaaggctatatatatgttgcccatattccacatactctgggttatgtttggtacttttaaataaatgatctgcatttaggttagagactggattggatttgacagctggaaagatggaagaagggatggaagaaggaaaggaagctaacacttcccacatcaaactggtggagtcactggaaagcagaagaggagtatgtggatgggaagaaagggaggcgggcctgctttactccctgcaagctgtaggccatggcctgcccagtgaggggcaagaatggggtgtgacagaggagctcagtggagcacggcagtcctggcacaatggaacttggcaaatggaaaaggaaacccctaggcttggccagattttccaaggtcactgccaatagatacagggcacattatgatagatgtacagtgtgacagaccaaaatcacacctgcagcagttattggtgtagaggttcagaaggtacagattccaactacagaaataattcatttaataataattgttgcccaatattagaaactgaatgatgtctgcaaggcatccagcattatcaaattcttgggcctactcggattgttttttggttggttctaagaaaaactttggaaaagatcttatctagctatgaaaaacaacccactccttgccttattccagaataactgagaaggaatctaatacacacacaccccaaaactgcagcaagctcagaagcggtgaactgcacatgatgacttccagtctctattgtcccaatcttttttcattcatgttatttatgggtaaaagaaaaccagattgggtcaggaatatcccaggttcttactacatctgtagtgtaccagctcctggcattttcattctggtctgactctagctaaaaccatttcatgttttgctttgaagaaatggataacatgaaatgataatttggctttacaaccttgaaaaattgttcccggcccaaacatctgccccagaatgagctcagctgacatctccttggaagagagggaggggtgggtgagcgaggagggcctggaaggaggaaaatgaagacaggagaaaggtcacctttccttgagaggaaagttctttgtgacaaagacatgaaataatacagctcccttatttcatcctgtgctccagaaggagatactggatgtgtctgctagctcctcctcctccctttatcccactttccccaatatttggtatgattaaggtggccccttacagagtgccaagaaactgtacccagctggtttgctttagttgtgcagtgacctgcctggcctacatgttatcttttcaatctttaagtaaggaccgtggctcaactttgtattcctgagagctgggccctacagagaaagcagagagggacagacgtgcaggctgggcttcatcctccttcttggccttcttaggagttcttctgggggatctttactgtcaccgtcttaacttctgagtactcccgcaagccaaattctcccctgaaacacagaaatgggccgggtcagataccagaagtccagggagctgcatgtgagtgcagcgggagtcctggggaggtgcagtttatcacctgcgaacagcaagtcctgggatgttcatgtaaaaattcctcacgtatgcgcagcccagccttcctctgagggtcagagaaactgtcatctcatgagtagtttttaaagaagtttttttaaaactttaaagttttttaaagtagttttaaagttaaaaggtgacttgttttcacaatactgcacagacaggcaatgactctcaattactcagagaactaccatcagccttggccagagggcacacagatgaccccaggctgtgctcagaggctgagtgctgtgggcagcggtgggaccaggcccaggtctctgaacgccttggccatgcctctctccacaaggcagcactggttcagtattagttctttgggacagtagtgtgctttcctcccccaagacggagggtgggagtgggttgcatgtctaagtgttcctgtccttctgcgtgtttactacagtgctccttctcctccacatctcttctctattctcctgttctttttgccttgtttaaatgccttttttccccttatctaatctatttcattataaaatcacgcatgttctcctctttttcttctcttcttctgaaagtcactcttcagtgatgcttttcccaacagcctcaggaggagctcctctttcgtcctctctgttcacagagccccttgttcacacctcaaccaccacacttatcacactgggaggacaaggggcttgaatatctctgtcttccctactgagttgtatcctactgatttttctttttgccttccaccaaacatagggtatagcctacaacagcaggcacaaagaaggtacctgatgaccaaggaaggaaggaaagtagagaggggaggagggaaggaggaagggcgagcttcctattccctcttcccaagttctaccctgttgtcatatcttctagatcaggaaaaaataaaaacaattaggagatatatttgaatatgaaacaattaaatgattaagaaaggctgtcttttgaaacagtcagtgtacgagttactgtggctgggctttacaagagagacctgctgtaaatgattcattcaggttccttttaggagcccccatggcctacataaggctccaggggctttgccagcacctcctctgagcaccgtgggcacctgagttgacagggacaacagagggcggccaaggagagactggggcaagcaggctgttctcctgtccgtatagttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgtaaggaagtctacagcatcagaaacctcacaattatggttgctttcaagtgtgactgttggatcctaccgtttgggtgtgtgatgcaatggaaaaccctgctggagcagagctgctcctctctgggtcctgagcagtgatctgtgcacgggggaagtggactcaaatctgctaccaaaagaactgctctgtgcccaggacatgaaggaaagccagtaagcagtcttagagcagcacgactgaggaggcatggaggagataaagagcactgaagctggggtcagagacaggagtgcccactcagctctgccatgaaccagctaagggatgccagctgagtcactgtcatcctcttggtgcccagtcatctctccagcagttcctgaacctcagtatacataagtatcacccaaagagcttggttcaacttttgattcttgaacgctacccccaccccacaaagattcagtttcagaagctctacggagggaccaggagactgagagacagatggtcatgtgggtcacactttgggaaacatgctcagaggtcattgagccctgaagtctcgattcttaagcaatttcaccatcttgttccaggatttctgtcgcatatttatttactccagctaaattttgtggcacatacagttaacagggaagaagctcactgatgcacgaaaggtatgcatatcattactgatgcagcccaatctctctgtgtggttaccttcacatcaggacgaaacagcaaggcaaaatcacatttagaagactaggttctagtccctaagataaatcaaacttggcacacctagaggctttaaggtaacctgtcagtcagtattggtagctcttcgccagccattttaggactcactcagacttgctcataaaacaagtaagagtttctgtttagggtatatattttcctgctcttttacttgacttgcagcagcatttttcagagcggagtaaagtctccagaccatcagcatcagaggagcttgcaggtggtcaggactgagagggtgggtgggagcgggtcaccggaaggcaggttgctttcaagggtgactggtggatcccagtgtttgggtgtgtgatgcaatgtaaaaccctgctggaacggaggtgcttctctgtgggtcctgggcagtgatgtatactggagtcactctggaagcttgttaaaaacgcagttcctgggtcctatcgcagatcaactaactcagaatctctgagagtgggtccctagatacgcatgcttaacaaaaccatcacccagactggaggtgacttctctgtatgcatgcgtgtacacgcacgcacacacacacataaatttgacaagctctgatttagagtatctaacaatgcttctcattttcaaagccagtgtcctgagtttttaaaatgctgaggttcacagaattctttccatctcctcagtttgtgacattttatggcttgtgctttgccacccctcatctcaggggagtttgataaggaagtaagaaaaaggacaggaaaagtgaaacaggcagaaataggtgggcaggaggacctgagaaaagctcgtctctgagcctgggaattaagagggcagccctccccacagctctctgtggggagacctcgtgggctaggtcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaaacatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcgatcatttattgaaagtatattttatgctcatgattcaccctgttaatgatctgtaacaaaacaatcaatgcaagcagcattcccagagccagtgactgaccccagcatttcagagactgggagagcacagacatagaggaaggaaatgaaataagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagatattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctgtagcagatcatatctaaaggtttcccagatttttccagttcacagtgatcttccctatccctgagctcctccattggtttacagtcttttctgcgattcctctgattctttcaatgttattagttttatttaccccaaaacatattaaatgccttaaggacctgcatcttcctccatagaccaagcacagtgctttgtacatatttatgctcaatatttgttagattgtgaactaggcatttgctcaaaaaaataggcattcagtaatggctgagggaacgggcatgaaacatgtttcctctgtgagtcacagcatttggcaaatacagatcagtttctttcaaaaggagggaaagtgggttcttttcctggatgttacttccaggaaaaacggttacttcctttgtgaagtcttctaggacccgagcagtcaaaattaattgatttttctctgtactgacaaaatgtttaacatacttctaatcatagcctttactacagggaattaatggtacattaattttttccattctcactttgggaaatggaattgtgttttattcatctctataacatgtaatagaacttagcttatagtagcatgtgctccacgaaatgtttgttgaatgtatggatgagtgtaagataattaaactattttttaagtactgctctgtgctgatatttgcaatctatttctctgcaggcatcagcaactttaagacttacatttctctcccatttccagacatcttgaatcccccaaaggggctctgggcatttaaggcattgtaacaattgatcctgaaagaagaaaacatagcactgtgagttcgtgtgaagtctgagcacataatctgactggcatggtatttcttttagaagttttatttttaaattcctttcctccagaggaaaaaattgtaatttaaaatctactttgatttctggatctaagcagtaaggagtgtaccccttttctggtgaactttggttgcttttggtattccccatccttccaaggagatacttgtttatttcaccctggtccctataccaccagtggaatttgttacaagactgactctgatcttaccaaacagtcccagcttgcattgcagaagacactgtgagggccttgttgatgtcattagtaaagacagctgctacgagtccaaagtctgagttattggctctttcgataacttcatccatcgtcttaaatctcaaaatttcctgaacagggccaaagatctgcaaaaagataatatgactcaacatggttgctctgtcattcctttacctgctttccacatttcaatgcaagtttactctgccttgattacttaaatgacctttaagtttagcagtacaaaactgtaaaatctcccaacctttcctaggataagattatgcaagaagagtctgacattagtgtttaacctccccaacttccccaacctctccagcatcacttgattccactgtgtatactaggggtgtcttctttaggtacagaagagcaagtggcatcctccgtgatcctgcaaacactgctccagaacggaatgctctggactgtgggctgatttgctccttgtccctctcttgcacagatgtaaagatgcttcagtggattctctctcctggttaacatcccagtgacccacatttaggagagccgaactattgccagtgtattgttgaggccaatggcaggctattctgattgttctgttggctaataataatcataagcacatagcatgtcacctggcctccacctagcttgcttgtcttttggtttatttttcttcttgaaactggaattttcatagccatgttcattactgttgcaaaatgaatatatgtaaaatataaagagctaaaactctaatatcatccactagaaatgctctagaaatgatcccaagaaagatgtggcttttgtaagaacagcatatttgatacctcctccttggcaatccgcatatcatcagtgacgttggaaaacactgtgggctcaatgaaaaacccctttcggcccagtcctttgcctccacattccagcttggcgccctcagccacaccactctggatgagttccaagatcttgttgtactgtttcttatcaatctgtgggagacaagacttaatgactccaaatataaccttctatgaaaatggaaataagtatgttcttgagaatctttcattttagggtttttttcaaagtttaactacacccagtcagatcatataaaactgctgttacttaccaatttttgacctacaaaaaactggcaattttgtatggttaatcctaatatatcgacgattccaataaatgtactgctctgatgatattgcctaatcagaagtaccagctgaacatttagaaaaatgtttcaaaatgatggagacactggctaatttactattcaatgttcatatgagggaaaattgacttttataattaaatgagtaacttagcaagttgtattgatagtaaaaagaggcaaaaattagcacacagcctttttagatagtgctacatacccaatcttattgtggtttgtttttaaaggaattcctattacacttttagaggaactttagaggaaaatattaacagtaaagagtgaaggatgagcttcctagtccaaaaaaaaacaaggtcagtcttcccccaaaaaactgacggagttatcatttgcttattatggtaaataacacaaaaacctacatttacccaagtttgaatggctcagccagaacatcaatcttctcttgaataatccctaaacccatgctttagtgacccatataagagctggtccaggttccttctgaaaattctcagaacctgtctacagattaaaaccagaattccctttagaaatatgcctcgatgattacggtgaacctgcagaggaggctgttcaggagagactttgtggccctccccaccccactaaagtacacgaggccttcagattaagaaataaccatacagcaaaagggaagtgagccagcccttcacttcctacactttcacaagctacaagggatctgtccagactggttcaggctgctggagagactccttggcagctcgtaaaaggatagatggctctaggaaagaaagatatctaccctccttgactgtggcatctgtagggatgtcctaaagttcagtgattggaaggactgggactgggttctagtgtccagacccatcttgtcatactcatggctttctttagaactgagagactccagcttagtcccaaaggtcagaatattcttttttttttttttttgagacggagtcttgctctttcgcccaggctggtggagtgcagtggcacagtctgtaagctccatctcccgggttcacgccattctcctacctcagcctcccgagtagctgggattacaggtacccgccacctcgcccggctaattttttttttgtatttttagtagagacagggtttcaccatattagccaggatggtctcgatctcctgacctcatgatccgcccgcctcggcctccctaaaagctgagattacaggcgtgagccactgcgcccggccagaatattcttaaagtaatggtaatcccatagtttttcagagataaaacttagaaagggacagagaagcataagaaataagcaatccctctctggctccatttccagccacgaagacatggtggagaataaaggagtcagccgaaaaggaagatgtcgctttgctgggacctactacagtgtacacagttctgtgccagtcaaggattaagtaaacaaagggaatggttatgatttttctacctggggaccctgctcagtggtggggtcaaagggactccccactacgcgcctcttggcccgctccacgcttcttctcacaaactcctcatagatggactcctccacgaagatgcgagagcctgcagtgcagcactgaccttgattgaagaacacaccctggtgggcctgctccacagcatagtccactacaagaggaaacagccatgttctcaccgctttgcctggggaggggcctgtctatgaagccgcctccctcccctctccaaagccctaggtatagtgtgctcactgcatgacataaccatgaatagccctggattgggaatgcaactagttctaactacaccctgacatgctatgtgaacttgaacaacttcacttctttgggtctctttcttattctgcaaacagaggtactgaacctcgtgtataacaggagtctcaaacccctatataccacagggcttgggagataaggtacaggtatgagtctgccaggtggtaaagcaatgtaatggaggggctaagaaggaaagccactacatttaatcattgccatgcataaatatgagccccaggttgccagatcctctcaattttcacagaaatcaatattttaatgtgcagttcttgttttgaacatagtgtaatgtttagacaggtaaacatgtctatattttgtatttggccaatttacaactcctaaatctacagggccttggggctgtatgtttggtacttgggggattaaaccgtaacaccaatgggtcttctttgaagacactaaatttcctctagattgacatggacttgtgtaaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggtgctgaaattcaagcaatctgcttttggttttctgatctctctggtggtgagactgggaaagcagctctgcctggcaacaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgtgtgctgtcatcctaactgaaagtcatgcgagcaacagaaaggggctggaattgactaaacagagaaggggctgtgggtttggaaaatgctggcagggctggtcaagtcggatttatttaaaatggtctaccagccaccaggcacagttgaaaagttacagatttattgaatctaggcagagagactatccttcaggtgctcagcagctgagaccactgctgttgaaccatatgccactgaccaagccttcatctcatccccctattctacaacatcacagattcaaaatggctcattagtgtctagaaaacaactggttcagtcgtcaactgaaaagtgctctttccccattattaaaccattttctccttagaggagatctttttgattgcccttagcttcaaatatcttttgctagtgtcccatcaaaagtggagatataaaagagagcaccaaagggtgtgtggtggttcatgtatgggacctgtagttgacttacagtcagcatcagcaaaaataatattaggacttttgcctccaagttccagagttactctcttcaaattacttcttccagctgcttcttggataagctttccaacctgaaagaagggaaatggagacaggttttgcaaatcctgcaggtgagacagtcaccggccaatgccagctcagggcatcaatgggatgcaacagtaacaaaccctaaaaggcaagccaacccagctcttgtcatcagcttgggttacaagatgtaagttagtggggtacagtttaatgtccatgctggagtgaactggaagacagctttagtttcgtgatggaaggactaaggaaaagggagttaaatctggaatcttaatcactgaaagatttctctaaagacaactggcaagaaaaatgtaactggagatttcaatcactgcattgtggcctttagctttggactccggctccagaaaaaagccaactggtgccacttgaaagatatcatgaggataaaacaaattgttcatgtatctcctaaaatgccaggcatgctttttattacatgctccaaagagactatcaatattacacctttgcctctgcctagagctacagtaaaaggataccagacagttgagaatctctctttttgtgcaatcttgtaaatgccgtttatcttgaatccaagtaaacaagaggctgagttaggagaaagcacttgccaatgagtagactcacattggcaatgaaaatgaaagtgtcataatggaagcaaagatccaccacttagagcccctgctcaaggcagaactctacctcagtgatggggaatgctgttgggagacagcctgcagctgtcacctccttcagggtccacctcagctgaaaagagctcccttgcccaaggagaagccctcttccaagtggcccatatccacccactggtggtggcagggtttgtataaaggtcctaccctttcagcccagcacaggactgggctctgagggacggtatatactccatgatgacccaagtgactggcagaggctgtgtcaggcctgtgttgcagttccacttccccagggccactccccttcagcagggatccctagtaaaatcctgcaagctaaactccaactccgtgaatgctccctgggaacctaacctacaacaggatgcgactccactggagagcacatatcactttatggaaaatgcagagcagagccgccatatagtccatagaggcaatttggtcttgttgagatgaaaaaatgttatttgttcctgaaattttcctgaaaattaaatattttaaaagcgggggaagagaaacgctacattcactttcaactcctgcagtcccttgttgagatcctccagtgggactaacgacttcgcaggcagcggagaaccccagctaggagaaaaggctctggagccagactgcctggattttttttttttttttttaaccagttctgtcacttcgtaactgtttgagcctaggaaatttatttactatctgagccttggatcctcctctgtagggggggataaaaatactatgtacttcagaattatattttgaggattaagtggtgtaccatatatgacacttagaacccagcctggcacacagtaagtgtgcagacatgctaaccatgagcaagtgtgagaagctggggcctcccttttcttccacgttcaatggacagaaatgggggtgatgtaaaggagacagctggaccttccaaagcaggtctcccgtagatctcccaaactgcctgtgctgttaactccttcagaaaaacaccggggaaactccaacttcccctcagtctccaatatcactcattaactgtaactctgcctcctcctaaaaaagattttgaaaatgtatccccatcctgagaaaagctaaccttagggggaaaaagtgatgtctctcaaagatgcagaactagagtttcttgatttgctgaaaacatgacttaccaaggtgttggaaaatgctaacacctggccctgaagtttgatgggtgagctgtggccaacctgccagactgcccttcccccgcccttgccattttgtgtctcttccacttccacgcaaaggcctcaggaagacctggtctcagtaaaggccctgttctcacacagacatggtcctctgagaagaaaacaggcaaacacaaagggaaggagaatctggccctctcttctgggaatgctgaaaattatgactggtaagggggaactcacaccgaagggcaactggggaaacagcaatcctctgacttactgccagcactcagggaggggtgttccctgaggatgctgtcatctgtgactgtctgctcttctgagaatgtcattgtgcttgctcgctccactctgggggaatccaaattaactgatgtggactcattttaaagtcaaggaagataaacaggtaactgctttctcaacaagacaattactggaattcacaaacatattattcattaaattaaaccagtatttattgagtagtctatgttagatacttacaagcattatgtcatttaagcctctcaaaaaaccctacacagtaggttttatctcattttagagatgagctaaatgagttagaagttagtgaatgtcaccaggctccccagctggttcatgacagaacctgttggactatctgcaggctgatgccagagcccaggcctgggattactccctctccttctcccttccttcctcccagcattctgtcatttttctgttctcttttctacatttactgagcactaatgtgtgccacataccatcaaaatcttatccctgcactccaagctgatttcaaagtaggtaggaatatcacctcttctagacaaaaataatgttcataaatcatcagttacaaaacttagattctgccttcaggattatattcaagaaacaagcaaaagccaggaaaaatcatgagttttacacatagtaagatgctgagtaaatatttggggttggcagacactgctggcccagctggcattacatttctgttagccctactccctgatattcatcagaccattctagaggttgatatttttttgccactagaaatgtcggccagtgattattttcatggctatggtaactatacaaaagtaaaagtttcagtctatgatcatcagagaagaatacctaagaataattttccttgcatcaatgctttaccagcctttccttagaaaacaaatttgtgcgctgcacccactaactcggtaaacaccacaaggcaaatctcagatgaatgatacctttccccttcatctttggaagaaagtcgagttatagttcaagaaagaacgggatgtgttaggctatgggagaaccacttccatctggagtggcctcaggacaggacactcctaaacagccctggttttcaccaatgtccttcattcaacacatattcatagttctcctactatgtgccaggtacactgttgggcatagtcccttaccaataaggaattcacagctaaaaggactcccatgtaaacctagtagatgttcaataaatgtggctttgcagtccactagaaaaaaaaatctgggtctcatttaatattagatctgaacagattaaattacagttcctcagtactttgttataacccacaggtttccgaagtcaaagcctgtgggattagaaagtataagaatgaacgaattacgcatacaacaaaggcctaggattgaccaatctttctaaaatggaaaagtttaagtgtggttcctcagggatactgtccctcctgacatgaccagaaggtgggagtgcacggcaagataaaggaggctgcaagggtgcacacgttttccaagtggttaaaagtcaagttaatagagctgtacttgatgataccaagtcctattctgatgaaattggtaatttgtaagataaaacaggtaaacatacagtttgagaaattaaatcctgtatatgatgtaatatagattaaataggataaaggcacagagatcaaatttttagttcgccatcaccttttcttccaagcagaaaagattttacaacgtactcgtgtgatacctcctgccccattgctgacaacctggctaattataaccatatttaggcttatggacgacagtttggcccacaggagtcagaagacctggtactacaaactctggcttctaatgaatcttcaatttgggaaagccacttctcctcctgggtctcagcttctgcatctgtagaatgaaggcacaggccaagcaacaaatctctcccttagtactccagttaattgaaggagttaaaaaagacagacaggactcctggggaccctgctcattctgagagtctgttcacaattcttgtgtttttcttgccttatgaagcagaagtagcttgttacaagtagaacaccacagctgcactgaatgatggaaaaacctcatctttttttagtttccctgcccagagctccttatgaaagagtaagtgatagtgttcctatcatgcagttccttaactttgcactccctgcagagcctctcagctctgtgtaccccaaacatgcaagggcagtgaactgggggctcctccacacataatgaaactgggctaattctcagcaggaatgctggcacagttcaactctgactcccatcctcgtttgaataggcctcaagattgatatcaggagtatccctggaagagccacagtgtactggaatcatgttcacagcaatgcggcaatgtaggggaaagcaatttggggctttgcaagaaaaataatttgttatacaggacaaaaaggaacacaaaaggcttttcatgccctctttattcagggcagttgctccctgaacacagtttctaaagttgggtaaaatttttttttattaattactcaggtgagttcctactcagagctattttattacacatatcaaggtagatttttctcagcgatataacacctttttaaaaatggaaaaatctctactagagatcccagtaaactagttaaagatgcctgtgtcttgtaatatcttttcataaatcccaaacagatttactctctgcttcttccctcttctcctttcttaattttcattgttatgcttcctggttccaactgtgttgggaatagaaatgccaaaaatatggggattgggtgtttgtctttctgaagtacccagaaataacaggccaaattaatctgtccagatttgcaccagaaacaaacaggaccaaggcatctaagcagttcctttaagtggtaacagcagtttaaacctttatctgtgaaattcagattatgaaggccagtataaccactatgtttccagccttctgtcccaccattcccaccaccactcacccacgactctaggcacacaaaaccacttgccctttctggaacatgcctgtgtgtctttgcataagctgctccatctacctgcagtgccttttcaccccttgcttacttgataaactcatttttacagagataactctttcacctcctctgagaaggtagctttccttccctaccctccctacagggtttggtgttccttctctgatctcacagtgctatgtacgtaactctcacattgtgcttgtttaatagctgtctccccgactacaatgactgacttttaaaaaaatatgcatatgtacacagattttaagacagggtctcactctcttgccaaggttgaactgtagtagtatgattatggctcactgcatccttgaaattctgagttcaagcaatcctcccaactcagcctgagtagctgggactacaggcacttgccatcatgcctggctaattaaaaaaaaaaattggtacagacagggtctcactatgttgaccaggtggtctcaaactcttggcctcaaggggtcctcctgcctaggccttgaaagcactgggatgacaggcctgagccaccagggcccagacaaactttcaataatttgttaagtcaataagccagaatacgaaaattgcttgagagcagtggtgtgatcacggctcactgcatccttcaactccttggcccaagcaatcccgccattcagccccttgaataactggggctacaggtgcacactaccaagcctggctaatttattttttatttttttttgcaaagactggggcttgccatcttgcccaggctggttttgaactcctgggctcacacgatcttctggtcttgatctcccaaagtgctagaattatgggcgtgagccatcgtgtccagctaatgttattgttgattgagcacctattctgtctacttgttttcacaaacattattttatttaatcttcatgacaaaactgggaggcaggaattattattctattttataattggaaaaaaagacaagacaagactcacagaggtcaagaaatgacttgcaaacaggcacccactgagtggcagagccaggactggtctcagaatgtgcacaccaagcctcaggctcttctccctcctcttctccagaccttctcctgggaattggttcccctttgctgtgagtagcattttgacagttaaatgcatcatctaccactaacatgttcaactgccttgtacacttagccatccttttgttacataagactctatttcaggtaagctttaaaaatcaaggttttgattgtcttggtctgctttgataggaaaaagcatggagtagtcaagccaaaagtactctatgtcccattaactaggtgagctaaagggatcaacaccttaggacctgctcaaactcagcctgagttttggggagaaagctaactgcagaatctttgacttagcatagttagagaataaatcatggaatctcatccagcaggcagagactataccatacttattcttcagtcttcaagttttaagaattttttaaaaagagaagttttatgctaatagtttaaaacctacacaaccaaaggtttttccacatgaaactggttttttcaatattttcatgacattcaaactggtatttttaaataaaatactgaatgattcacgaatggactcacacaaccttagaaaaaggcctattagctgtttatagctaaaactgtagcaagccacctcccctaacctaaaatgaggggtgaagctaactaggagagagctgacctgattcatgactcaagcagtagagatggtgcttgtatcatgcaacatgacatttatctcacttaggaaataaaagaaccccagctgcgtaaattagaatgagtgataatacagctgttagctacaaacatttgtttggcacgaatcaatctggactctgctgtagtttgctttgatggtctctccactatcttgctgctaatgatgagatcattgtttgttaacctgagtaaagaaaacactataccaagcaaaatgcatattgttttcctgtactttattgaagttgtttattgacttgtgtttataagagctcttttatatttattaaatatttacatgcactgcttatgtatttagctgcataaggagaaattaatcccatctttaatctgagtaaagttgttggctttctaaaggccttttgctttagtaaaatggaaagcagccacctcaaataagcttcttcttgttaactgttccagacactttgtaatgtaccaataggtcccatctccctaaggtaatcacagcagaagccatgttctaatccatatttaagtgacatgttcactctggaagaatctatacaacttctcaggtagcctgcaaagttagaataaatggataaagaagtaaataactacagctgaaaaggggtttggggattatgtgatcgtttgatttgcctgtgaaaattctccatccaccactactaatatggaaattacaaattggcttttatattctagacaaatgccgctctcccttaagtcctttagtgtctgccaataatgtcattccagagaagaaactaagagataacctagaagtcacgggattagttcccctccaaatgaatgtaagcctctctacagagagagaagaatcaaatgtagattctgttagaaagtttagctgaaaacttgctctattcacactgtaataggctacttaatattttaactattcctaaaagcaaaacaattcaaagacccaccttccaccctattctctttcccaaattctcccttctctctctctctctcagttccctattgaatatctcagtattggaagattgcataggtagttgttaatgttttatttgtgaagataaaaaaattcctgttgttataaagctataatagtcaaaataatgtgatacttgcgatgcaacagtcacacagattactgaaacagaacagagagtacagaaatagacccatatagggccgggcgcagtggctcatgcctgtaactttgggaggccaaggctggtggatcacgtggtcaggagatcaagaccatcctggctaacatggtgaaaccccatctctactaaaaatacaaaacattagctgggcaaggtggcgggcgcctgtagttccagctacttgggaggctgaggcaggagaatggcataaacccgggaggcagagcttgcagtgagccaagatcgcgccactgcactccagcctgggtgacagagcgagactccatctcaaaaaaaaaaaaaaaaaaaaagaaagaaatagacccatataaatatggaaaatttatgcttgaaaaaagcaagcatcacaaaggcaattcagtggaggcagggtagtcttttcaagaaatggtgcaggaactattgtcattatccatctatctagcacttggatccttacctctcaacatacacaaaagttgaagtagatcataggcctaaatgtaaaacacaaaactataaaatttctagaaaaaaagcatatgagaaagtctttgtgatcttatgttaggcaaagatttcttagataccataccaaaagcctgatctataaaagaaaatgttaataaactggacatcaaaattaaaaactttaagagacactgggagaaattatttgcaaagcacaaaggacttttatccagaatatactaacaattttcataattcaacaatgaggaaaacaaacaacgcttgtctccaaagtgtgcaaagatttaaagatacttcaccagagaagatatgctgtggcaaatacacaaatgaaaagacactcaatggtagagaattggaaattaaaaccacattgagacaatgctatatacctatttgaatggctaaaatgtaaaagactaaccacatcaaatgttggtggggatgtaaaggagttcaaagtcttaaacattgctggtaggaatgtaagatggtataaccgatttggaaaacagtttggcagtttcctgccctaccacacaatccagccattccattcctaggtatttacctaagagaaaaggacatacatgtccatacaaatatttgtacatgaatgttcatagaagcttttattagtcccaaactgaaaacaatccaaatgttcatcagtggctgaatggataaacaaacatacaacaaatggataaatccaaatgttcatcattggctgaatggctattaaacctgatacaggttgaacatcccttatcaaaatgtgtagaaccagaagtgttttggatttgggatattttttcagattttggaatatttgcattatacttaccagttgagcaccccgatctggaaatccaaaatccaaaatgctccaatgagcctttcctttgagcatgatgttggtgctcaaaatgtttcaagttttgggggcattccagatttcagattttttgaattcagaatagttaaactatatacccataaatggactactacttggcaataaaaaagaacgaattgatatgcacgacatagacagatctcaaaataactgtgctgagtaaaaacagctagacaaaagagtatatactatatgttgccatttatataaaattctagaaaatgcagataatctatagtgccagaaagcctgggaatgtgggggtgggggtggagagagagataagacagagagattacaaaggggcactaggaaacatgtgagggtgagggacatattcattgtgaactctactgatggtttcacaggtagatggatacacatggccaagacttatcaaattgtacactttaaataagtgaaatctattgtatatcaattatactacaataaagctgttaataaaggtacattaaacaaaaatattacttcattacagaaattatgccatatatctctttgttgtcctttgcagactactggcagtagttggtctttgcacaactactgaaaaacaaaggaaactacgtaacatttttctgcaaagaaatttctccctacaccagaattccattctggcaaactcagtttgaaggagtggccaccactctaggccacagcaagaaatcatgagtgagttccttaataggtaccaggcatcttcttccagcactgtattttttaaaattatactttgaattctgggatacatgtgcagaaagtggaggttttttacatgtgccatggtggtttgctgcacccatcaacccatcatctacattagctatttctcctaatgttatccctcccctagcccgacaggccccggtgtgtgatgttcccctccctgtgtccatgcatcctcattgttcaactctcacttatgaatgagaacatatggtgtttggttttctgtttgtgttagtttgctgagaatgatggtttccagcttcatccaggtccctgtaaaggacatgaactcatccttttttatggctgcatggtattccatggtgtatatgtgccacattttctttatccagtctatcatcgatgggcatctgggttggttccaagtccttgctattgtgaatagtgctgcaataaacatacaagtgcatgtgtctttatggaagaatgacttataatcctttgggtatatacccagtaatgcgattgttgggtcaaatggtatttctagttctagatccttgaggaattgccaccatcttccacaatggttgaactaatttatactcccatcaacagtgtaaaagcattcctatttctccaaatcctctccagcatctgttgtttcctgactttttaatgatcgccattctaactggtgtgagatggtatctcactgtggttttgatttgcatttctctagtgaccagtaatgatgagctttttttcatgtttaacggccacgtcttcttttgcgaagtgtgtgttcatatcctttgcccacttttcgatgtttttttttttttcttgtaaacttgtttaagttccttgtagagtctggatattagccctttgtcagatgagtagattgcaaaaactttgtcccactctgtaggttgcctgttcactctgatgatagtttcttttgctgtgcacaagcggtttagtttaattagatcccgtttgtcaattttggccattgcctttggtgttctagtcatgaagtccttgcccatgcctatgtcctgaatggtattgcctaggtttttgtctaggatttttatggttttagttcttacgtttaagtctttaatccatctttagttaatttttgtataaggtgtaagtaaggggtccagttactgttttctggatatggctagccagttttcccaattgcttggattttgttaggtttgtcaaagatcagatggttgtagatgtatggtgttatttctgaggcctctgttctgttccattggtctatgtatatctgtgtttgtaccagtaccatgctgtttttgttactgtaaccttgtagtaaagtttgaagttgggtagcatgatgcctccagctttgttctttttgcttaggactgtcttggctatacagggtcttttttgattccatatgaaatttaaagtcgttttttctaattctatgaagaaagtcaatggtagcttgatcgggatagcattgaatttataaattactttgggcagtatggccatttttgtgataccatgagtatggaatgtttttccatttattgtgtcctctcatttccttgaggagtggtttatagttctccttgaagaggtccttccaatctcttctaagttttattcctgagtattttattctctttatagtcattgtgaatgggagttcactcatgacttggttgtttgtctattattggtgtataggaatacttgtgatttttgcaattgattgtgtatcctgagactttactcaagttgcttatcagcttaaggagattttgggctgagactatggggttttctaaatatacaatcatgtcatctgcaaacagagacaatttgacttcctctcttcctaattgaataccctttatttctttcttttgcctgattgccctgaccagaacttccaatactatgctgaataggagtggtgagagagggcatccttttcttgtgccagttttcaaagggaatgcttccagcttttgtccattcagtacgatgttgcctgtgggtttgtcttaaatagctctaattgagatatggtccatcaatacctagtttattggatttttagcatgaaggggtattgaattttattgaaggacttttctgtatctgctgagataatcatgtggtttttgtcattggttccgtttgtgatatattacatttattgatctgcatatgttgaaccagccttgcatagcagggataaagccgactggattgtggtggataagattttttttttccttacagacagaggttttattgtgtttggtccacagtcatatttcacattatctcatggagcagggcccctgggtggggggtccctgtgcagtacttggaggggcatgtggccgggggagatggagcagtatagctggtcaggcccagaaggggagaagggctggggctccttaagacctactaaggggccgggcacggtggctcacgcctgtaatctcagcacttagggaggccaaggtgcgtggattacctgaggccaggagtttgagaccagcctggctaacatggtgaaacctcgtctctactaaaaatacaaaagtagccaagcatggtggcacatgtctgtaatcccagatacttggggggctgaggcaggagaatcccttgagctcaggaggtggaggtgcagtgagccaagatcatgccactgcactccagactgggcaacaactactaagaaaaaaaccctactgaggccacggtggtggtgtggggagttggggggattaggcccaaccactcagcatccacttccttgtacaggcctcactttccccactgggccctgaggcaggtctgaggtctgttggcctgagggtcctagggaaatccagccacttgggagcctgagatatttagcatcatagacaggccccctttcccaggggactcatttcccagcaccctctccactgtccccaccccattcctcaggaaaaaaaaatgtatttttcttttgttaatgcatcctgaaacttttgcgggtatagaaaccacaaactgatcggctgacaaaagtgggaagaggcaaggcaactggaaacctccgggtactggttccctccaagcccaggtctcttctccccggcacagctctgctggcagcctggacgtgccagcagggaccctcaccatacacatattgggatatggccttgaccccttctcctccacagcctggtggctcattcctgcgaaggaccaaggcaagggggaagaaagccctgctgcctgattccacgttgccactcacagaccctcggttgattggcagcactgaacaggttaagaaaaaaaagatgaaaacacagaaaaacccaaaaacccagaaagggagataatgtggggagagagtgtgctgggagcctcagtagccagcctcctcctggtagtaagggggatattcagggacctctcctgggcccaggcagttgccagcacccaagggagccccgtcagccactgtgcctggcaggcagtacttggggtcacatatatgctggcccaggccaaagacctggctactatggttggtaccctgggtgtagcccatctgcagggacatggaggaattaccacacttgtcggttcccagcttggtgtcacagatgtgctgccgcgtcccaggagctgtcatgctcacctggctggcacagttatttgtacccatctggaggccaatgatcgagtggtccatgggggggcaggatgtgattcttggggtcacacagatgcctcttcacgccatacacggtcatgcccaactggctggtacatttgttggtgcccatttgcagcccgatgacgcactggccagccttcatggcggcgtcactgaagttctgctcctgcttctctgagtatttgatgccaatgtccaccccgctctgcggcctcttagtcttgaccttccctgctagggcaaaaagagacacctgcatgtgcctcatgttcccactctcaaacaggttgttggccttgaacaggtccatggggttcatgtcatagctgactacagccttgatgaagttggagaggttttccagctggtgccacttctgcatggagtggttgatcttggggaatgaggccggctgcagcttgttcatgagtatgcataagataatcccgtccttcaggctcttctggaagtcaggctcaatggagatgcaggtgagtcccttgatccagctgtgaagctctgcctccttctgggggtcatatttgggcaggagccagttcttgacctcggctgacagcccatactagacgcctttgttgaactgcgtggaactcatggctggcaggctgcgggatggggccacacgggacaggggtggataagctttttgatgtgctgctggattgttcatcagggatattggcctgaaattttctgtttttgttgtgtctctgccaggttttggtatcaggatgatgctggcctcataaaatgagttagggaggagtccctctttttctattgtttggaattgtttcagaaggaatggtaccacctcttctttgtacctctgatagaattcagctgtgaatccgtctggtcctgggcttttctttttggtgggtaggctattaattattgcctcaatttcagagcctattgttggtctgttcagggattcaacttcttcctggtttagtcttacagtattctctgatggtagtttgtatttctgtgggatccgtggtgataacccctttatcgtttcttattgtgtctatttgattcttttctctttttctctttattagtctggctagtggtctatcttgtttatcttttcaaaaaaccagctcctgggttcctgcactgtattctaaatctagtacactattttaccaaaaaagaaaaaggattcatcatcattttatccaagcaagcacgaaggcagtcttccaagaagtgaaatagaagagcaaacacacacacacacacacacacacacacacacacacacagacacacacaaacactgactggtagccaaaaatatttgtaaaatatttacaaaagctacaaaataaacgaaaggagagtaaagctgccagaggagagcagaatgtagttattgacaaatatattatttgcaaatggaagtttcagattcacctaatagttactgaattcttactatatgccaagcaatatgcttggaactttcaaatacattatttcaatcttcaaatgagcctgtaaggagtgattcataggccttactaatggaagaagacatgaaataacagactaaacaattcgccaaaagtcacacagcaggaaagctggaatttgatccatgatttgtggatcaaatccagtgcctcatctattataccacacttccccaagcattaattgtcccataaacttcattttaaaaataaatagaaaacaatgacagttaatatttactgacactttactaagaattagatccagtgctaaacactctagatatactagcttttcttagtccattcagtttagctataatgtcccagactggatacctaatagagaaaggaaattcatttcttacagttcgagaggctgggaagtccaaggttgagagacccacatgtggtgaacgacttcctgtggtgtcatcccatggtgaaagatggaagagcaagagacgacaagacagcacgagattcaatgtgcaatctcaagcccttttataatggcattaatctattaatgtgggttaacagattagtacccacctgaacacccctcactagtgcccatctctcaacactattgcattgtagattaaataacaaacacactctttctggggaacacattcaaatcatctttcatcctcacaatccatgaggtaggtacaatcatctctaatctacagctgggatatctgaggcctggaaagattaaataataacatgtaatgtgaatgaatccactcaagtataatagatgtttaagttgtctagttttctgatatgactgacatatttaatcttgattcctttagtatgatttgaagactatgttcaaaacttactgaaaaagtgatgatttcctttagttggtttagagagacgcaaactatagagttgtgatatactattctgtcaaactttcattttaagaaagcactgaggagtactttgttttcttttaagagactctaagtaaaggatgaagagaaattaactcaggctgaactacattaatgctgtaaaaatcctaaagtaacgttaaactttatgggttggtctttgttgataattagcttaatcagattgatcatttactgttcagcttgggaattatctttgcttatgacaagccatctgcatagttttgtagatggacattacttgccctcaatgtggttaagaataatataatctgaagtgtaaaaagatgattcatgggaaatcactgttgaggaaagcctagtattttctccagcttttacacactttggtaccccctgactattaactactctcactagaacactgaggctacatgtttagcagtcactgagcatgtcatgttcagtgttggctcacctaccaagagttaacgaccctaggaaatcagacacacactacccttctcaacatgtcccatctggtatgatttaggttcttagggatgtgttgtttgtttttattttcccatctctataaggtttttcacatcctattaaagagacttctaaggatagacactgaattcaaaaaaaatctgcagctctggtgtttaaatgactgttaaaagtacaactgcaggaatgacaacaaaactgcattcgctattgaaaggaaacagtgaaacctaatatcccatcctaccttccagcaaaatatgtatcgagcttttacaaagtgctgattctttaatatctggcataggaaatgatgttgagaataaatgataccactatttgttgattatctgccaatatcaaataacacattgtgagtccctgaggactcacgagggtcctcacagctagcattcctttcctcgaatttctttttgtattttggttcccataaaactacagttccattttctccaaagagattaatgttaagagaaaaggaagacagccttaaattcttgccagttgtgactattaacaactgtggaattaagatggagaattatctttttcttaaaatacttttatctttgaataaagtagcttttcattcaaatgtaaatatcttcaactgatgacacttctcctagatacagatacatttgaaaattatattaaatgacagaactttagttttgtccttgatcttatcatcttgaaaatcatgacatttttaggtaatgatgcagagaattctcttctctccatgctcccataacacaccacactctaatagttacatattcacagattatctcttgggctagactgaatcacataaaacaccacctttgcctctccaagatctataagtgcttgataaatgtttgtggaattgactggaaacaacttaagttttaaattttcatgtcctatatcagacagtgtcaaatggaaaccctgtattgtaacaaatggaatttaaagaggctaaagatgcaattttgaagtgaattttaggaaaaaacggagttacaatgtgtctatgacctaagcatgctgcactgagaaattatccttcctaagtacctccattaatatgtcattccgaattttaatggctctcccctatgggagggtgtatagtcccttagcctgggaggcagtgtaccactgtaatatggaatataggccctgggtgtgactctcagccctacaactaactagcatgtaaccctgggcaggtaatgtaacccctcttagccacactttgctcaatgctgtagggttgctgtaataatgtattcaaagcatttagcaggtacttgacacaaagtaagtgctaaatcaatgttggctattaatatccaaaatgtaaagcctttaatactttgtaaaattaattgatttttcacagcttgagatataactcatataccataaaatccactcttttgatgtgtacaattcagtggattttagtatattaacagagttgtgcatccatcacaaccattacttctatctgaggacataaataccccaaaaagatacttcatattccatcagcagtcactttccattctcccagtcctttgcaaccactaatcaactttctgtttatagatttgcctattctggatatttcatacagtcacatgatacagtcttttgtaactggattctttcatttggtatagtgttttcaaggctcattcaggctgcagcatgtataaatacctcactcctttttatgggtgaacagtattccattgtatggatagaccactttttgttaatccgcttatcatttaatggacatttgagttgtttccactttttggcaattaggaataatactgctgtgaacatttttgtacatgtttctgtgtggtattagattttgtcacgtttcttctgtgatgatcacctggtttttgtcctttattccattactatggagtattacattgatttttttacatatataaaaccaatcttgcattcctgggataaatcccacttggtcatggtatataatcatttttatatatttctggattttgtttgctactattttgtcgaggatttttccatctatactcataagatgttggtatatagttttcttgtgatatctttgtctgtggtatcttctacatgttggccacaattttttgacccagaattatttccaatgccttgatgtgcatattatttcccagttcatctgactcccaacgtttctccccagtcccttcccaattccgttattccactaagactttgtgttctcctgcttcgagttgttgactaacactgccctttcttcccaattcactctacttatctatatcctacagaccctcaaatccctctttctcttgaaaccttgatagaccacccaacccctagagctctctcccttcttgagatgctgatgtcatattacaaactaacatttgcttactgcttaaaatttcccaaactcatattgcatttaattcccatgaccctgagaaacaggtatgtatgctattattaaaccaattttgtacaaaaccaagtggctggtccataattatatagctatgaagtaaaaaatagtaaaccctatgcttatggtggcattttaaagcaggggagggttctactgatacctcaccttctagctctgagattaagtttttatttaccaaattcagtctttcctccttcatgtagcaacaaatatttactatgtatgtttactatacataagatactatttgaggtactgagaaggcctaagggatagactccaaagagaatgtcctccccacaaatcttcatatatgaccagaaactgccatcttttgaaagtaaaacttataaaaatcaagactaaactgataagcaaatcagctcaaagatgaaaaaggagttacttatgagagtaaagtactgcttaaatattcaatattaattaattaaatcaagggcttttccaaatccagtatgtccttatggttgtattcctaatactttggtttgaccaactgaagtaaataaaatagtaacctcattaactgtaaaggtgatctgcatgaaacctaaagaaaatcaaacaatatcaaaattaatcaaaaggtgccagagagacttctgcttctaattgtaatggagtaaccgacactggacttgttttaccattataaacaactagaaaagtatatgaaattgttttattcaaacattggatatcaggcagtatgggactatgaatctagagaaaaggaaatccttttgtgcctaaactttctagattgcagtatggtatgaggagaccaaagcagaatatgatggtctgaattctgaccagacagataagaaagatcttgttgaacactggggacattcaacagaaacctcagaaggatttcagcttattaataagaataaactagtcttaacaaagcttaaaggtaagttccaaaagagacaagctgaacctcaagtaacttaactaccttttaggaaaaaaaaagtttgacattctttaaagaaaaacaacaaaatctctaagttcagcaatataatggtcacaatgtccagtatcctttcaaaattaacagaaaagccaaaaaaaaaaaaaaaaaaaaaaggacccataaacaggaaaaactccagtcaaattcagagacgacagagaagttaaaagtaacagacaaggatttcattattatattattattattattagatggagtctcactcccgtcgcccaggctggagtgcggtggtgtgatcttggctcactgcaacctctgcctcctgggttcaaggaattctcctgcctcaacctcctgagtagctgagactacaggtgtgcaacaccacgcctggctagagatagagtttcactatgttggccgggttggtctcggattcctgacctcaggtgatccacctgcctcagcctcccagagtactaggattccaggtgtgggccaccacgcccggccacagacaaggattgtaaaatagatgtctacacaaatttaaaggaataaaggggtgtagcgaggaagaaaatataagatatttaaaaaatcatggaatttctagaacttaacaaaatctctgaagcagattaagcattacagaagaatatacgaacgtcaaagatgacaatgaaagttacctagccggaagcacaaaggaaaaaaatgctggaaataaaagagtcccagtgacccatgggataatgacaaatgacctaacatatctgtaaacagaaggcggaagtagaaagcaaaaaaaaaagatttgaaaaaataatggtcaaaatgtttcccagtttgatgaaaactataaactcacagatatacagaaattttaacgaaccaacaaaatacacaaaagtacatcacaatcaaattgctgaaaactgacaaaaagaaactctctcaaaagcagtctgggggaaaagaaacattacttaccgtaaaataaagataacaatgattgctgtatctcatcagaaacagtaaagtcagaaacatgccagaatgatatctttgaagtcttgaaagtaaaataaaacacaaactgtcacattagaattttatatccagaaaaaaaagttagttattaaaaagtgaagacaggccgggtacagtggctcatgcctgtaatcccagcactttgggaggccgaggcgggcggatcacgaggtcacgagatccagaccatcctggctaacatggtggaaccccgtctctgctaaaaataaatacaaaaaaattaaccaggcatggtagcgggtgcctgtagtcccagctactcggaaggctgaggcaggagaatggcgcaaacctgggaggcagagcttgcagtgagcctgagcaactactgcactccagcctgagcgacagtgaggctgacccctcaaaaaaaaaaaaaaaaaaaggtgaagacaaaatgaagccattttttagacaaacaaaagctgagagaagtcatcactagtagacctacgctacaagaaacgttaaagatcgttacagataaggaaaattatgccagaaggaaatgggcctacaacacaaacaaggaaggaggccaggaatagcaagtatgtgagtaaacagacaataattttgtattcttattcaaaaaacaaattttaaaacaaaaacagcagcaatgtattgtggggcatataacctatgtctaagtaaattatagggcaacaataacacaaaggatgagattggaacaatgctgctgtatggttaccacactgtatatgaagtaacataaagtatttaatggtagactgtgattgaggtgcatattgtacacactaaagcaaacactttaaaaagaggtacagctaataatgcaaaatagaataaaaagagtggtaaaattatctaactcaaccaaaagaaggcagacaaagagggaaaatatggacaaagagaaaacaaatcaaaatgggggattttagacccgaccatatcattaatacattgaatgttgaacaacaaaaatgaaaacacgaagagtagatattattccatttatatgaaattctagaataggcaaaaataattaaaaagaatcagtggttgccagaagccaagggtgttacctgcaaagaggcatgagaaatctttctaaggcatggaaacaatctacatcttgattcggatggttacacaggtgtatatacatggtacttaaatgggtgcattttattgtatgtaaattatacttcagtaaagtcatttaaaacgttaaaagatcttcagtggcaaaacagatttgaacccaagctgccttgcaataagcacttatggttttatggactcactatgtggcttcttgtctggcctgaaagaggagattccatttattcaatttaacttccactacctgatattgttatgtgccgggcgcagtggctcacacctgtaatcccagcattttgggaggctgaggctggtggatcatgaggtcaggagttcaagaccagcctagccaacatggtgaaaccccatctctacttaagataaaaaaaattagccaggcatggtggtgcgtgcctgtagtcccagctacgaatcacttgaacccgggaggcagcggtttcagggagccgagatcacgccattgcgctccagcctgggtgacagggcaagactccatctcaaaaatgttactcgtttttagactgaaatatcttggaagaaaacattaaatgctagaagttaatttatcaagaaattcctaacacctatatgatgacatcagtgatgaacattacaacaaataattgaagggatttttatcatattatatcatattcctagatgaggagtcaatatggtaaagatagcatttttcctcattttaatatggacatgtaatgttatgccaatcaaaattccaatcaaagttttttagagtaacataaggtacttagaaaatcggtttgaaatttcttctaaaagaataaatgggctttgaaaaaccaaataagagggtatgttgcctatattatagtaacacatcttataaaacctagtaattaaggcagtctggtactagtgaaagaacagaaaaaattatgagctctaaaacagaaatttcctgtatagtttggtgcaaaagtcattgcagtttttgccattaatcaaattacttttgctccaacctgtatatatggaaatgcatcatgtaatgttatattcaggcatcatgtaatgttatattcagatgagttgcaaaggggtagactgtttaataaattgttttgaagtaactaaacattcatttataaacaaacaaccctcacctttcattatacatgaaaataaattccaaccagattaaagatttaaacaacaaaaccataaaagtactgaaagaaaatattaagggccgtttgtataatcttaaaggggtttgttcaaaaatgacaggacggagcttgcagtgagccgagattgcgtcactgcagtccgcagtccagcctgggcgacagagcgagactccgtctcaaaaaaaaaaaaaaaaaaaaaatgacaggaaatccagaagctgtcagaaaaagactaaaggagaagactacatgagaatttaaaatctgcacatggcaaacaactgttttaaaaaaattaaaaagcaaagaacaaacatattttcaaattctacaacaaacaaaagattaacatacctaacctcttataaatgaaaccaatactctaaggccttcttggtaagcaagttgtaaatatgtttttattttgcaattccacttctagaaccatatccaactgagcatctaatatgtacacatatacgtgtgtgtatacgtatatacatatgtgtatacagttacagatttacaagtaaaatttttcttgggtctccaaaggtttttatttcagcagtctgtttaataggaaaaattagtggaaaaaccaccctcaagtgtacattaatacaggattaaatgatgatatactgatgcaagagtattctatgcagctgttaaaaataaatgccggagatgtaggtactaacatgacaaggtgttatctcttgtttgacatattatgctgtcatttttaatttaaaaagttacacaataggccggacaccgtggctcatgcctgtaatcctagcactttgggaggccaaggcaggtgaattacctgaggacaggagttcgagaccagcttggccaacatggcaaaacccccgtctctactaaaaatacgaaaattagccgggcatggtggtaggtgcctataatcccagctacttgggaggctgaggcaggagaatcgcttgaacctggggggcggaggttgctgtgagacaagattgtgccacttcaatccagcctgggcaaaagagtgaaactccatctcaaaaaaaaaaaaaaaaaaattacacaatagaagcctcttgactgactcaatcaggaccattggttggtcaacagaaaaaggttaaagcagaaaaagatactttaaatatttcatttctccagtcttttgatatagaaccaagaactttacttaatcatgggtccacctgtctcttctgattaaatcacacccctaaattattatttatgatttctggtttcaatttccttaaagtgaagtaaggacttaagaacatttgcaaagcaattccaggtgcccattctatctaggtttatatttttccccagtcttttacagttgtcttaaattgattgcatctttagtttttcttagcatctagcctttagcaaatattttcaaagcattaaacttcagaataattaataattccctttcatactcacattttggtttaaatatttcattaaactgcaaaattacaataacaaatacaactagaataaaatatttggaaacaaacaaggttaactcgacaaacacaaaactcagtaatctaactgaattaatattcaagtttattaataaatcttttattaaatttactactgtgagtcagtttaaccaagtataattaactctgtatcaactgataaaatgtttctagatctgtgctgtccaatacggtagcacgcatggcaatggagaacgtgaaatgtggctagtctgaagagatgtgctgtcaatgtaaaacacataccatatttcaaagaatgcatatgaaaaagaatgcaaaatattgtattaataacttatagtgattatatgttgcaatattttgaaaatactggattaaagttattaacattaatttcacgtattttttaatgtggctactagcttattttaaatgacaaatgttgctctcattctattagatagcactgttctagacctgcggacatcctttgttcaatgatgatatcatctgtgaggttctacttgaaacaatgaatcagactttcctatcatctgttacctggatcagagatatttgagtaacatttataaatcttcttaagctgacttgtgactctgtaacagggatctgtaaactatggcccatgggtcaaatataccctgctgttttggtatggcctacaagctaaaaccagtttttgcatgtttaaatgtctagaaacaataaaaagattagcatttgtaatccatacaaattatgtaaaaattccaatttccatgtctataaataaactttaattggcacatagccacactcaatattatctatgactgtttggtgatactatggcatggctgagtagttgcaacagagaccacgttgcctccaaaatttacatttactatctagccctatacagaaaaaaaatgtgctgagccctgctctatatcatctcttaaggttcatggggtatagtgagttgccaattgcacctaccggacctgtccaaacaatgagaagggaaagcttgtgtctccattcttatccttaccagagactagtttagatttccagcttcttaacttgcttctgccgctattcaacaaagtgtctagaaccccaccttctgggatagttcttacacagatggtatcacaaaaatgctcagatatctgtggggtcaaatggtccctgtgtgcctttgctttcacatccaccagtgttctatgacaccaatgttatcctttgtgggcttgggtactcactgcccttttggtgtctagcctatgggtactagttttattgtttttgtaacccctcaactcatttgcaagactgttcctcaagccctggtttttcagatacctacctcagtagaccctgtgaatgcaatcttgtctatgccaatgtgagaagctattgctgccccagccgttggcccatatcctggcaaaatattgatgaccccgggaggaaagccagcctaagaaaacagaacaggaggaaacgtggctgatgaaagctgatgcatcatgttaaatgagatatgctctagtaggctccagctgtaaggggagtcagaagcactcccgaagtccgtttctcttacctccttgatgagggctcccatgtagagtgcactgagtggtgtttgctctgctggcttaataactactgtattgccacagcacaaagctggagctattttccaggcaaacatcagcagggggaagttccactgaaaggaaaaaactcaaagttgatagatggaaaaacattcttccactactttgttttcaagctgtgacttctcatatttctcaaactagtcctcgacataaatcttgtccactacaaagtacagatgtttggattttcaattacttcattaagaatagaatagcactgaccttggaaatctctccttttctctctgaccaaccaattactatactccaactacccaccaaaagaaatcccactgtgaaaagggagttttgttacttctttgttttgttttgtcactgtttttatgttttttttaattaggctttggttccaataagttctcgtgtatgaaaacttttcttgcatctgagatttttacatcacaattttcacactggtatgaaagctcttcaacatggaaaaactagaaaattctaactgagttgtagttaagtcaatgtgtatttcaaggtagtactttttctttagatacatgcattgtcacaaacatatatgattacaaaaaataaactgcatatactgatgagtatgcaaaaattttcatttgtctcttttccactgtaaaagaagctattggagactacagtaacatttacatgagtagatgaggttggggtctaaaatggtttaaactgattttaaaaagatattaagcttgtattgtcataagctcaggcatgagcctcagtactatcaggtgtcattgataatttcattaagaaagaaaacagaaatcctcatcccctggcttcagcccttgaccacaatgtgtttctgcctgaagcatctcagctgccatccttcaaggcttctcactggctctggcaagcttgcaaaaatatacaagtgtcttgccttcaccaaacacccaatttcttttccccttagttgtttataaacttgggagtccaccgtaatgttttaattccatctacagtgtataaatcttaaagtgcagtaattgagccagagctggctgacaagcagctcttgtcctgtcagtgaagctgcagcgttgagagtctgggcaagggcaagaaaagtaagtttgaatcctacgaggaaggtgacagacctcatcccagagctggtccaagtaggatttccccagggcctttaagagcaagagaacttaaatcaaacctctcattttcccttggcattctctaataaatttcacagtaacctgggattcatcaattattcaaataaatattatatcttccccacatctttggttcccaatgccaaagattatcttgagttatactactgtactttgaaaaaagaaaacttcttgtctatactgtaagagtttactttgagcatccccttgaaatccctgccagaactattagctagtactgttaaaagctatggtcatgttttgtattgtaccaagggtgtgtatgagagacagacaggaacaaagggacaatgtttaatgttccaatccaaacactaagcactacatctatttctctttacaagacacataacagctcggcatggtttcaattatgactgtgacgttaactgtagtgctgtgtcttctgtagcatcttctatctagattcttgagaaaagaaacagtgggaaagaatgggattaaaagatcatataaaataatatgcctggaaggatggtgagtcacagttctaaaaaataaacaactataacaaagcattaattttccataagcagaatggacataataaccaagggcaggttattaatacactgtgctttgcttattttaatcatgagaattccatgacttgagaattcaactcctggtaacagagctgaaaccctattaacctgttcaaataagcatttgcagggaggctgttaaagatatgtcaacaacatgagctcagttttttttcctccagtaatggaaaacacacatcgctgaggaccatgttttatgtgtctttaagagaactgggtcaaatgaaaataaatacgaggtgcgaggaaatacactcactgggatgatctgtccacacactccaatgggttcatgtcttgtaaaggtaaaatagtctccatctgaaagaaaaaagcatggtcactcccagaaagtttagattaggaaaaaaaatgcaaagggagaactttggtggctgcaaaaaaaaaaaaaaaaaaacaaacagaaataaacttgaaaaaacatcctactcaaccgtgcatgaaagctggtagaagcctaacactggacatagcatatttctggatatatctctcagacacccaaatgcagtattgaggaaaggatctctaaggcaaaatgaatgacaaatttatgatacaagaagtcctcagggtggcagaggggacagctgaaaaatatgtaaaaattgaattttatgttaaatattaaaataacatgtagaacagttgtttgatttaaaaactgagtcaacaaacctttaaataactttctgaagtattaaaataaactaagtaaaatgctattgggcaaatttaaaatgctcggcaactggaaaaagtgaggagtaaaagatatatttcataactcaatccaggtgtcaaaatgtacttcctgggtagtgatgagacataggcatgtccagggctatttaaagaaggtaaaagtccatttctaaaaagaactccatcaataatccaaagcgtctgcccccaaactagacatagaaatgagaatgtcctaggggctaaaagaaaaagagcttcagaaaaacttaataaccttgttttccttacaggagtaataggcaactgaaataattatacaggaagtccaaaccaaattcatctttaggaaaatgtcattgcttttatctgaattattttaaatggttaattaaaattaccaaagaatggctcatttttagcagatagcttttcattttaaatactgggcaaagtctttatttttccctccactgccggcccttaggccacttcactgatacttgttttctctctcaaaagcagtcccctaaggcaagtgaaaacactcagctaatattcatgaaagcataactattataggtggaaatgaaggtggggacaggaggactgtgtgggtcgggaaaagagaagcgatatgaatcagattgtttatcactgtctctcaacacacctaaatcacatttatcacacaaaattgttttgacatattcaaaattatttattttttaaataattacattaaagtcttggcctctctctctctctctctctcttactctcccagtgtcactctctatcctctggatctctgatctctaccccctcttgccataattatctgtttcctcttttcaaggaacttttattcacatacaagtatttataggatccttttatcctctttttttttatacaaacgggatattattcagtcttttatattttgtttttccctcttttttttttttttcctgtaaagctaggacgtctttttagtggctgcaggttattccatgggctcaataaacaatgttactactgtaaaccctcctactaagggacatagaagtcactttcagtttaggctattataaataatgctgcaaagactatcattacaaacatatcttttcatatctgtggaatttcttgatctaagtgtatgtacatttcagattttcaaaaatattgccaaatcacccttcagaaaagtttaacaattcataatttcaacaacacgctatttttcctactctttaacactgaggtttttccaacattttcatttcagctaatctgatagctggaaaactgcaacttgttttgatttatgtttaatgatagagtgaacatcttttcatgcttatattgtttgctatttttctattgggttattctttttagccatttgaagagctctatggatattaaggaaattaggcctctgtcataatattgcaaagatttttccccaatctgctacttatctcttgactttgttttatgtatattttaaatggaagaaattcagaagtaggctggattctgcaactgtatgaaattaatttaaaatatctattacgagaaaaaatagcgaagatgttgcaactgtccataggatgacagtatgaagtctgagtaatactttaaacatcaaattaactatttagctttgtatgcagataactaaagaatcttctggatatcattctttacaagactacaaattaccatgcttcttcaatttgtaaatctctgaaaaggtttttcatgaggagcaacaccactgatcaataagctagagtttcatttacaagaaaatcttctgcaactgaactctctaagttggttaaggtgatgggttcaggtggatagtcacagaccacagaatcagagagtaatgtcaagaaagagtgcaaatggggctgaggaaaaaaattggaagatgaacagaagagtacacgtgtttattttagcagcacatgtaggaacctggaatggttcagaaaaaaaaactcacaaggcaactacacaagcactgcatggcaattcataaaccatttccccctacacattttatgatgcttagacatttagttgttttacttaaataatatcacaagttaccgaaaaaagtgaaagggaagaaaatgtagacaaaaatcttaaaagtcggacctcatgaggaattgagtttgactccataattgtgtctcaagagaaactgagttatgaggaattaaaactctcttggataaaccgttcacatatttgaaaagcatttagctacaggctaacacagggaaagagacagaatcttctagtccctacagttagtctaagtagcaaattaaaaaataaacgctatttttgtgcttgaactcttcccaaaagagcactgagttgaagggacaaagaaaggaggctactttcaataaaattcaacattccttcaggttaaaaactctcaataaagtagaggcattgatggaacatacctcaaaataattaagagtcatttatggcaaactcacagccaatatcatactgaacaggcaaaagatggaagcattccccttgaaaactagcacaagacaaggatgccctctttcaccactcctattcaacatagtattggaagttctggccagttctttctcaggcaagagaaagaaataaagggcattcaaataggaagagagaaagtaaaactgtctctttttgcagatgacatggtcctatatctagaaaaccccattgtctcagcacaaaagcttcttaagctgataagcaacttcaactaagtctcaggatacagaatcaatgtgcaaaaatcacaaccattcctatacaccaacaatagacaagcagagagctaaatcatgaataaactcccattcataattgatacaaacagaataaagtacctaagaaatacagctaataaaggaagtgaaggacctcttcaaggagaactaaaaaccactaatcagggaaatcagagaggatacaaacaaatggaaaaacattccatgctcatggataggaagaatcaataccatgaaaatggctataatgcccaaagtaatttaaaaattcaatgctattgtcattaaactaccactgacattcttcacagaattagaaaaaataactttaaatttcatatggaacctaaagagcccatatagccaagacaatcctaagcaaaaagaacaaagctggaggcatcatgctacctgacttcaaactatactacaaggctacagtaaccaaaacaacatggtactggtacaaaaacagacacacagaccaatggaacagaatagagaaatcagagataagaccacacatctacaaccatctgatcttcgacaaacctgacaaaaacaaacaatggggaaaggattccccatataataaatggtgctgggaaaactagctagcaatatgcagaaaattaaaactggaccccttctttacatcttatacaaaaattacctcaagatgaattaaagacttaagtgcaaaacccaaaactatgaaaactctacaagaaaatctaggcaataccattcaggacatgggcataggcaagattgcatgatgaaaacgtcaaaagcaatcgcaacaaaagcaaaaattgacaatttggatctaattaaacaaaagagcttctgcacagcaaaaggaactatcagagtgaacagcctacagaatgggagaaattttttgcaatctatgcatctgacaaaggtctactatccagaatctacaaggaatttaaacaaatttagaagaaaaaaataaccccattaaaaagtgggcaaaaggacatgaacagacacttctcaaaagaagacagtcacgcagccaaaaaacatgaaaaaaagctcatcatcaatgatcattagagaaatgcaatctaaaccacaatgagaaaccatctcaccccactcagaagggcaattattaaaaagtcaagaaacaacagatgctggcaaaggtgtggaaaaataggaacactgttcctatttcccactttgtttacattcccactgttggtgggaatgtaaattagttcaaccattgtggaagacagtgtggcaattcctcaaagaccgagaaccagaaataccattttacccagcagtcccattactgagtatatacccaaaggaatataaatcattctgttataaagatacatgcatgtgtatgttcattgcagcactattcacaatagcaaagacgtggaatcaacccaaatccccatcaatgatagactggataaagagaatgtggtatatatacatcaaggaatactatgcagccataaaaaggaatgggatcatgacctttgcagggacaatagatggagctggaagccattaacacaggaactaacacaggaacagaaaaccgaacatcacatattttcatgtattgggggagctgaacacacatggacacaggaaggggaacaacagacattggcacctttctggggaggggtgggggaaggcagaatatcaagataaatagctaatgcatgctgggcttaatacctaggtgatgggttgacaggtgcagcaaaccaccatggcacacgtttacctgtgtaacaaacctgcacaggtaatccagaactaaaataaaataaagggccctagaccttgtaatctcactttgcattttcacgtggatggtgaaaggtgacacccctagtctgatctggggtgcctgacaaacacaagagctaagccttctgtgggcaccttcagctagggctaacagcaccccagaagtcattcacagctactaagaccctactatgaattccactgaacttctaaatcagggttaccgtaagaccagttataaaagccatcttcataatttttgccatttccaagtatcatttgctctgtcatttacttaatttctgttaaattaactcacctgttagaaatatgtaaatagctacctgttagccttaaggaaaatctaaaatctaaaataacaggtttcatgggctggtaatattttcttctaatattcttcaaaccaaggaattaaaattaaaaaagtttacttgcttactgtatagaatcatcttgaatgctaccagtgctacacgggatgctatatggtgattctcaaacttgaatgtacacactaagcaactggagatctcgtgaatatacagattctgaatcaacaggtctaggatgggaccagagagtctgcatttctacatgctctcagctgaggctcatgcttctgatccacagaccacactctgagtagcaagatcaggagtgtaaaggggagtccacgtgtattatgatgccctatggttgcttcacagttgtctgccttcatttttatttattttttgtctctctaataactctactaattttcctgaaaggagtatatagtgtaggagaatctgatctgtatttttaatacttcaaaattgttaaaaaaaaaaaaaaaaaaagaatgaaaacactattagaatttctgtagagccttataattttcacatccttatctcattttacactcaaaactctctgaaaaaaatagagcaactatcattatcagcatcttataaacagagaaaatatggcacagagaggttaagtccaaagtggcaccactggttgaggctcctggacttggatctgggtcttcagacttcaagttctttacccataaaaacatattaatgactcttgtgaggaaggtgttggatttaggtggataatcacaaatcacagaattagagtataatgtcaagaacaatcacaaatggggtaaaaataaacaaagaaaaaacctcaatgacaactcttttgtaatatgaacacagaacacatggaaacttgttataaagggaacactacagagaaacattccctggaataggtgagcccaggactaagcgcctctctccctttcatctaggcagagccaactcgaaatggagacagtgttaattctccctctcatctatacctcagatgatacataatgagtactcttctctgcctagaaaaaattaaagccaattttccatcttttatgctaacaatggtctctcagtatggcaggatgacttagaaggttgtttccttcatttctctagctttgtgctgtaagctcaacagcctgatataaaaacagtctccacccaaattcagatactccattgtagggtatgaatggttttggatcttcttagcaaatatgagggattacagagagtgctcagacttagcataaaaaaggactgcatttgatggggacaccagaaaatgttctggataccacattgtaggtcaataggtgagaacacaactatgatggagaaaactaaagaaaagatgagagatcaaaacaaatactaagtcacacgtgtaggacttttgatctctgtctcttttccctttcactcagaaggtaaaacgcagactaacagatattgctcttaaaggggggttattttaagacccagtcagaggtaacttttctgatgagttttgatacctgggtgcttttaatgaccaaatagtagtttacaacttatggaaaatataaaaatcttacaattaaatacttcattatgctatgaatttggctgagctgtgaattaaattttactgagtatgtgtgcattgagccatttctataattatattaagaacagcccttgctgctagagatcaacagtacaataagcctctactatatttgcgaactactgagccactgttctatgttttttgatggggccttatcaaactacacagaagagagagaaatatttaattagaaaaatttaattatttggataattcattcaaggcaaacattacttcttaaatcagatcttacagttgcctgaaagaaactgatggaatttttagtctcataaaaatatctcgcattggcacatcctatatattaatataaactagagtgagtatgactaagcaatctgtaaacagtgataaaatcagaagaatctgaaatgtgccagaaattgagaaatttgtcaaatatggaagtcaaatagcttccaattataacactaagaacactacaagaactgtagcaaattttatatacctagtaacaataaaaacgattttattcaatagcataaaaatctgtaacacaattcagtgaatgaaggtcatcttccaatccctaatttgtagacagaattacctttcaaggagctggcaattctttgatgaccacagtattaaaaaatgagatgattacattgaactattccattatgtatgtactgtagcagattcccatcatgttgacgttgaacagacctcacccaacattttataactatgatgataaactctataaatgcctatacaaacgctgaaactgtatgttagtatgaagtgtactgatgcttttcttcccagaagtctgctggtagtttctaagaagttagattatgttcctgagtctgtcatgaagatagcttagctctacgactattccactacatgatcgtaacaaaagttagtttacttctctggaccttctctgtaaaatcaggagatcagccttagggatccctgaggcccttttcagcttcaacctcttaaaaaggttccttgtgaagctgacttcatgacctcctgtcacaatcaattcaggtcccactaacaagcaagccctggttgttgttaggtgggcagagcaaatcacccctcactcttattctgatggaacaagaatacttcagatttcaccctatgcatttgttaatgacagtaaaccagatcaagctgattcaaggcaaaatcttaggatctgaatcactatctttgtgtatttgtatcctattctttaacaggttaaactggaagagggtgaaatggaaagttatatatgacctgggtagtttttaaccttttctatatgctaacatatcgtaagtccattttaatatcagaattcagcttaaaacatggacatttttttctgcttacataaaatcagtaaaatcaacacttgctacagagaaaaatctaaggcaatacaaattaacttccatttctccctaagtaaatgaaaaccaagcgttgatccttccttcatcacaaagaggttgtagacgtgagagaagaggatttgaatacaggttaaaaatactcaaaatggagaaaacaatacttttctttagggctgctataacattagcgataatgtaacaggtaaaaaagtgttccataggtcatagtaatgattattatttatcatcataattaggcactgccatcgtaaaagggtcaaagcttaggatttatggtcagagacaatggctccattgggtaccatggcaggaaataatggatagtgttgtaaaggaaacaacatcaagactcttgtgaatcaaactagtattgcataattgtgcaataacatccagctgtgggccttgagcgaaacagaatgaagagtggtgggagaaatttccaattcagagagagaagcagccacccactttttcattgctcaaaagtggtcatgagataacccttttgtctccttcccaagtattctagttgaaggctaccctttacggggagaaattaagcaggtatttgctctctctaactgattatccatctgtagtcaaagtgaaatctatcctttatggggagaaataaaacaagtacttgctgtctctaactgattatccatttgtagtcaaagtgctctttctaaaatgcaatttttcaaatagattcaacgggtttatgtgcagatttgttacatggatatattgcataactatgagccttgggcttctagtgcgcccatcaccagaatagtcaacgtggtacccaacaggtagttttcaatcctcagccccctctcactctccctccttttgaaggctcccaatgtgtattaggtctctccgtatgtccatgtttacctaccgcttagctctcacttataagtgaaagcatgtggtattagtttctgtttctgggttatttcacttatttcagtataatggcctccaaccccatccatgttgctgcaaaagaaatgatttcataatttttatggctgtgtagtatcccatgatttgtgtgtgtgcgtgtgtgtgtgtgtgtatatatatacatatatatatatattttatccagtcatccattgaacagcacttaggttcattttatttacaatagcccctccaaaatacctaacaatatttaattaaggaggtgaaagatctctacaagcagaagtacaaaatactaatgaaaaaaatcaccgatgacacaaatggaaaaacaccccatgttcatggattagaagactcaatattgttaaaatgaccatactttccaaagcaatatacagatttgatgcaattcctaaaatgtaattttgatcaaggcactcacctatttaatttggtgactcactattgcctacagaataaaacttgcagcatggctgacccagacttggggctctactgtctttcatatctgcttatacttttagatccactaactcatggtactctcctccctcatactttgtgccagctactcccactgcctgtaatgtccctgactccatgttcacttaacttgtccttcaggttatcacttagacatcccaccaccctctccaggaagccttaatactaggagatgtctctcctatggtgtcccaccaaatttcatgcttccatatctaaatagatcacactatattgcagttgcttcgctacttgtttttcttactgtcctataaacatcttagttatttgcctttgtaacccaatgcctaatacaggagctgaaacatagcagatgctaaaaaaaatctgctgaataaatgaatgtatgaagaaatgggtgaaggaataagagatcaaagttgatgccacagaaaggaggtaaaagaaaatcccttccaattacatgatacctttccctagccttcccaaatgggaatgagtgaaagacataatggcttatttcttcccattctttttggttgtttagtgttagagatgttatgctggatgaaccatggagtataattcaatgttgtaaagcagtcttacatctaaaaatttaacaacaaaaaaccctatttcaggttctttttttatgggtgaccaaacagaactgtgttactatctctgacactcactatgaaagccccctttacccatatgattaggatctaggcagggagatccccacctcaagtgttccagaacatttaagcttcataaatgctatcttgagaaaagtaggctctagatacagtcgattttcattatttgtggattccatatttaaggacttgcctactacctaaaatttatttgtaacccaaaaataagtacagagtgttctcagagtcatttacgggcatgtatatccaaagcagggatttttttttttttatttcaatagttttgggagtacaggtggtgtttggttacatgaataagttctttagcagtggtttccaagattttggtgcatctgtcacctgggtagtgtacactgtacccaatatgtagtcttttatcactcaccccactcccatccttccccaaagtccattataacagtcttacgcctttgcatcctcatagcttagcacttacttagaagtgagaatataagatatttggttttccattcctgagttacttcacttagaataatggcctccagctccattcaagatgttgcaaagaccattatttcattctgttttatgtcagagtagtattccatggtgcatatttaccacaccttctttatccactcgttggctgacgtgcagttaggttggtaccatatttttgcagtttcaaattgtactgctatagacatgcatgtgcatgtgtctttttcatataatgaattattttccctgggtaggtacacccattagtgggattgctggaccaaatggtagtgccacttttagttctttaaggaatctccatactgttttctgtagtgattgtactagtttacattcccaaccagcagtgtgtaaaagtgttccctctcaccacatccacgccaacatctattttttttatttttaaattatggactttttttttttttgcagtagtgaggtggttcagctgtggttttaatttgcatttccccaaagcagggaaaattttgagtcacctgatgcacaaattctcagctggggttgagcaaggtgacactctgccttcttgcttcagctctcatattgttaaaaaaaaaaaaaaaaagtgtccttttttgtggtctgtttagtgccacatttttcatatttttgtgccttttgttcacaattttgctgtttaaaatggcccctaagcatagtgttgagtgctgtctagtgttcctaagtgcaagaatgctgtaatgtgccttacagagaaaatacatgtgtcacacaagcttcattcaggcatcagttatagtacttctgtctggttggccatgagttcagtgttcataaatcaacaatatatattaaacaaagaatctttcaacagaaacacataaatcaaggccattctctgatcagcagacaagaatgttgtgatcagaagctcacaggaacctaatcttttatttcccctaggagcaatagttccatatttgctaattcagtgttcgtgacaactttataaaacataactactatgaatgatgagaataaaccatatattagtataaaaatctgcactggggtaaagacttcatcatattagtataaaaatctgcactggggtaaagacttcatcagggccaccttcctgccttgctgaaccaatctccataagaagagaatttatcatggcttaggcagaacaacacttaagtttgaatctcacgtctcccacttactagccatgtgaccttctacaagacactaaacccttgcagtcttattttcttagatgtaaaatgggtaaaataccatttaaaatccagactatctcatcagatcacacacagaatcacatagatattgtacataaaagaatattttatacttttaaattctatgcaaatataaagtacattatttctttataattcccaacataaaattaggttgttttgtaggaaaatgcatttagcacaataaagatctcatggttaaagactaacggactttctatattccagacttcactgtgaaaaaaaaaaaagccaagtatgcagagacaaaatgaagctgatgttaaattatggagttacaaaagacaaatacaaatggattaatttactgaacaaatttgagaacaagtgaataattatgattacgatacccctttctgtgatcttcccctatgactcccctgatttagtccagctacattcactaagcactagactagctaaagacattgttggctgaattctaagtggcctctaggcaagcccaaatgtatctaaaactggaaaagagaggacagctgccaagttaacctctacctccatccttccctcatctgtttgagacaccatggagagagctcttatgacccaaacttcagcctcctgagaattctgtcaacaggcctgatggcagggagggtacctcatcctagtatgactctaaatgcactttcagaaaaactttttggggaaaaacagttacttagagtttaagagaattcatcgttttttttccttcattgactgaacaacagttaatgagtaaagtggggaaagactactgtgagagccctatgagagccttttctatgccctgtatttataactcgtagataagcatccacaggatctccaaaacgcatcagatgaaaacagtgaggcttatgggccaaccacctctattgccagatcaagttacattaaagcttcaaacattatcagggatgtcaatcaatatttagctttatctaatcaggatcttccctcctgaggaagtaaaagaaaaccaaggtaccgttaggccaaatagagatctatgtgcattgccttctgtttcacaatcttcctcagagctttgtaaatagtttgaaaagatatttaaacacctgaaacatatttgttgttttaataatgaaatgacaggtggagtggggaccaaaaaaaccaacaactagggactttgatcttgtaaatttacctttctgtactgatacaggacaggcccacctaaaaagactgacatgtgtcccactgttgacaaaggttttaattctcaggccctctaataggtatgctcataacgaatagtgactttctacctcacttaggccatccccacatcttgcaagtgatgctggaaaacagctgttctgtaatatccttagagtcagaactgaactaagattctgactttccccaagggcaatcttctccacccttctcagtcagttgaacaagggaaaaacctctagatggaagggaagagcccctacaatcagaaacccattttctaaaaactaacattccacatgtcatcatcatttgtaggggcaatttaaaaaataatccttggaagtcttgtctctaaatcatctccattctcactgtaaattattcttacccttgtcataccacacctacatgaggcatcacaacagccacctaacttggttctgctgcatcctctccttgctactcaatgcagaggaccagaagctggttagacatgcagagtctcaggccccaccccagacttattcagtcaaaaactgcacttgaaaaagaccctcagtgattcatgagcacattaaattggagaagaactattcccagccatccacactatcagccaaaccactcccttttttagtaaatcagtactgctcagcctggctaagaaggcccaaaagagacacttcgaagtcctgagcattactttccaatcctgctactatgcactctccatggaaagcagactgccttctggagaacacaggtagaacacctggcacagtgctaagtggcatctagtatccactcaataaatgtgcatttcctttccttatgtctattcaccacttactatctctttcagtccatccctttcctataaggatatctcttcctcctaggatctattttgaattctctaatgaagtggttacaagcctaggttctaacgtcaaagttttagctctaaaacttatttactctgtgaattaggaaaactaattttacttcgccagacctctttccacttttgtaaactgaagatgtttgtaacagtgcctttctcttggggttgctgtgaaagcactcaattggtattagctatcactagtattcaagcacagataaaaatctcttcactgactgctttagttgctttagtcttccatactttccctctcatttaaagggctacagcactgacaggtaaagtacacaacttagcacccaattataacactcctataggggcctttaagttttttgtattgttgattctgtcatgtaacctgaatcttaataataaaaaggggttaggattagtgttgtttgtatagattatgaaagtaattcacggccgttcgagaaatatagaaagtagagaaaaatattaaaaagacactgaaaatcagccataatctcaccactcagagacaactgttaacacttagaatatttccttccaaagagtagatcttatatgtttcaggagggcaaggagcaagtcttaacctcgttggaattttccatgacttccctccacccaataatgccccttcatacctaccccagcacctaatctagcacaatgctgaccacttaccagctgacaaatacatacctcttccttagatgaatgatgtattaagtggcatgcccctgtacttatatatttctatctatagaaaaagggatgttgtcagagtcagtgacataatttggttggttcttcactcagttctaactgctgtaagtgtgctcatatctgtattctgtgtgactgctgtttgtgtttggtggccaaagcgcatttctggtggtttcacgttttccttttcaacgtactcagatttcacatacctacaggaatggtcatcccatgaattttatcagcccagcctgcgtaatatcgaaaggttttgatgacgccctgcaaatccacataaaaagcttgcaggaatggtttgccaccatttagggattccatggtctgttggaagagaaatggagagatactaagtccccagaactttccagcgatacactaatttctagagcagaagaaaaaaggaagagagagaatacaaatgcatatggagttgcatacctggtcaactatgaattctcaaataaaaagatttctagtactgccagtttggtctagttcctagtaaaaaccacaatgagtatatatgtgcatattcctgtgcttccagtaaccactatccaaatacgttaacacaatatttctttaactaatgataaagaaatgttctgcttgtcaaaacagcttccgttatattaatgatcagagctcactggggattttttggcatctacaccagtaatctgaatccataaagaggagcagaaacatgggctctttatgcaactgatgagaatagaaagtgttctccacagctgccaagacccctgctgagaaatggaatatccatggtgcacagcaagtttatttattaccaccaaataaacaagatctcctctagggaagcccagatgttaacaacttaaaggctggttttttgtaaacatttacattaacaaccattacctattaagagtgaaatatctgctccatttaataaaaatagcaatattgaactgctttacattataaacattgttattttaacgacatgttcctgaactggctaagtccgtaacaaaaacaatgaacacgctgaaatgagaagagtattttgacttgagaaatattaaaggtgttacaagttcgacaaatgaaattaacaaacatgtttgtaattttctttttttcctacaagtgtattttataagacatactggtgtgaaaattatttgatctctgacaaagctaaaattaaaatattctccaatcaatgagatgaaaatactatgacttccagtgtaatttatctacttagtatgtgtataaaatgaagcttatttaaaaatatcatgttacttatcactgtatattggctcacccttaaaaaagggaatcaaactatttcctagtactttttagaacatgtatatgtttacaagataggcattacattctctatacagctagcatagcaccaaaatctgcacagcttagagtgaatagtgtcaataaccagaatttgggctgcctaaatggtccctgtgagctgccgacaccagtcaaatccactgacaattgccagctctaggactattttcaattgtgtttactttggatgcaggattagcttcagttttccagtcaggagctcccctttcttccacaggctacctcttactaaaactcacttttctcatagcttgagagtgtttaaaacaggaatctcatttaggtgtggtaggaaaagagacctgatcagtgagacacagagaagaaaaagaaaggcatttgagttttattatatgaaaatataactggagaaattaattaatcatcttctagcacagtgttaatccaatgctatagatatcatatatctttagctcaattaaacagtcatttattgacaacctatgtgccctcatttgccatttatgtgctaagaaccatgctaggattaccaaaaaaaggtaaaatacaagtttaattctcaagaaaatgataatccagtgaaaagacaagtaatgtgtcccaaaaaacttggttttgcatgatattggtatgttagccagaaaaatggtgatgagactcaaataagcttgagaagcatttagtaggcttttcctgagcctttaatatgcccagtgtcttgtgaatctgcaaggaggaatttcttcaccatgaaacacctttttcacagtatgaataaacacctcattggaagagtattccctagagtgccagattagaaaatatttttatatacacataaatgttatatatagctagaatcccaaaccatttccataaaggaatcattttgttcccatactatgaacagattcctgagggggatggtagaagggaagaactatggtaggagggacactgagaaagggaaaaaatgattccttccccagaagcaagcccaatagtgacctattttcccaagtaggggaaaggatatagtactcatggcttgaatgccctgactgaacaaggaaaccctaaatattcattgataccaggtggagatcccaaatgtatagtgcatacattcctaaatgctttcagtttccaaaaagtttatattctctaagaaattgacttttattttaaaaacagcaacaacaacaaaacccattagggcaggagaagttcgttatgtgaggaaaatcattgttttagtgaaaggaagttgctatctcctgctgtctctcctttctactggctcacagaatgacagggcaaacggagcagaagtgtatgagaggtccgtaccatcccctctggttctgaaggattccttttactcaagagaggttaactctggggaggtaaaaacttgttctatttcattctcataagaatcatttgatactcgttttctgcaagcagcatggtgactctcttgttgcttgactgtttttaatttgtcatggggagggggagttttagaaaagaaggtacttaccagtcatggcaagctccagttttctcttcaaaattcagtgagaaaagatattcagctgatcctccatttctccttctccatctgatccccaaatccaaacatgtctcatttttcatatgtattacctattcctttgctttttccccaggtctgcttcaaagtatccttttaggagctcaagaccagcctgaccaacatagtgaaaccccgtctctactaaaaatacaaaaattagccaggtgtggtggcacgtgcacgtaatcccagctactcaggaggctgaggcaggagaatcgcttgtacctgggaggcagaggttgcagtgagctgaaatcgtgccactgcgctccagcctgggcgacagagctagactccgtctcaaaaaataaaataaataaaaataaaataaaatacagccgaagaatgtaaatttcagcagaatggcaaatgtgggttaaagacttaatgttttcttaggttacttactgcaagaactgccctgtcccgttccaccaagtctgcaagcttatccaacagacgtcccctttctgaagcatccatccttctccacactgaaccaagagagaaagccaggcgggctgcctgcactgctttgtctatatctgcctgttagagaggaagaggcacaactgaagaaaaacactc

SEQ ID NO: 1157 - DNA, 14021 bp, Homo sapiens
actgctcttccagaggcaagaccaaccaagatgaggtgggtccacagctttccctcctgcctttcctctggttctttatttcagtcttttttgcatacattggtacagatgcagaaatagaacaaagaaacagggcaaatgggctaaattatagtgaaccaaagggcttagtgtgttaaatcttctccttttctgcatccatagaagacagtgctgctgtctttcccaggagataagatttactctcaggagtgtctttttccttgaggttacgtttttgtctttgtagggtatgtcatcagctcccgtggtaggcttcctggcattcggaatatatttactagcagatattttcctctttaaaaatgtataataagaaagactaatagtaacacatttgaatgacacaattaattgactagtacttgggatacacactagtacctgggatacatctaattaagacacttagatcttaaaaaataaaaagactttttgaaatgttgaaataataagactagaaacttttttttttgtgagacagagtctcactctgtcaccaggatggagtgagtggcgcgatctcagctcatcgcaacctccccctccccggttcaagcaattctcctgcctcagcctcccaagtagctaggactacaggcgtgtgccaccacgcccagctaatttttgtatttttagtagcgatgtggttcaccatgttggcccggatgatctcgatctcttgacctcgtgatccacctgtctcggcctcccaaagtgttgggattacaggtgtgagccaccgcaccctgcctagaaactattttaatagaagcaaatagtgcctgaatggtgggcgtctgttagcgagatggtgaactggcagatggcgcctgtgtgtcaatgcccatggccaccgtcctgctttcagacaccagttctcttccaggtaaccttctggcattttggggtttgagataccatttcctaaaggtgaattatcacaaaatactagaaataaccacataagtgtttaaaattattgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaacaaatttggtggcccatacagggaaaacattgtcctccgggaaagggtctttgatcacctcttgtgaggagacacatcccactgccttgttgcagtggcctcatgagtaaggaatcgagacccacctggtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttaggacctcagttatacacttgggtcgagcaaatgtctatcctaggcatcttcttttcaggggaggaaagaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggagcctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggtgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggccccctttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggccatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagacagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaatgatgatttttttttttttgacggagttttgctcttgttgcccaggctggaatgcaatggcatgatctcggctcaccacaacttctgcctcctgggtccaagcaattcttctgcctcggcctcccgagtagctgggattataaacatgtgccaccacgcctggctaattttgtatttttagtagagacagggtttctccatgatggtcaggctggtctcaaactcccgacctcaggttatctgcctgcctcggcctcccaaagtgctgggattacaggcatcagccactgtgcccagcctatgatttgttaattatactagagatgctcttaaagggacagctgaacaattaagacccaccagtcaaatggcctgggaaaataaaatagcattagacatgataccagcgaaagagggtggagattgtgtcattatcggaacccgatgctatacttttatccctaataatactactccaggtgggatcacaccaaaagcactacaaggtcttactgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaaagaaaaaatactgtaaaatatttaacagggggattgttaaatacagtaagaaattcttcttcaaaggttcagcttgcttaagtttccttgttctttgctccctgctttcaaggccagacttccttactctctgtgttctccctgcgctggtaaacaaccttcccgccagtcgttatctatagagcccacattccacatctgctacccactctgtgaattacccctcccatcacaatggcttctcccggcaaaactgatcttcctgccttcccagcagtgtaatcacattcctgcacttttcaagttagccaaccgggttcagcttagattgtacggtccaactctagccaatggagtcaggatacagtagcagggacaagctgcgttagacataaaaacctctgctttcctttgttcggggtgctctcgtggcaaccgaacctatgaggagcaaccttatgcaaaagtaaatttgccttgctgagagaccctttgtcctttgtctcagtgctagttcttctttgcagcaccaagcatttgttttcaacaattatatatttaaggaatctttgattatggaaaatttcaagaagtagagggaatagcatactaagccctctgttcccatctttgagttatctacattttattagaagtatctttggggtgactgagggaggtttctctttcctggagggcttctgaattattgccaatgtaccttcctgactgcagccagaaactgaggcccctatacctatgtacctttctatccctctctgaagcttctgcagaattcccagcaagacagagcttgctggaagcttggtatgctcagaagcagctaaagcgtgtatgtggggcggagggtgggggcaacttcttggtcctagcacttccatatattgattttcttttctggctgcttagtgggaggagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtctgcattctttctttgagaacacacagttccccattcttatcctgacctctgggctttcaggactgccaagaacattggggatcctgccagaaatgaggggagcttgagctttcgttggcttctatttggggtagaaggagattgatgtgcagagcagcttccactcatctgacttttcatgggtctctgggaacaatttccaaatggtaaactctctggcttctctctctttgcagatgaccgcttcccgaagccccctgagattgcaaatggctatgtggagcacttgtttcgctaccagtgtaagaactactacagactgcgcacagaaggagatggtaagacctggacaactatctctgtgctctacctacaacccctgctctgacatttccatgatgggtggtgctgaggtgatttgccagaaagttcgttgctctccttggagccaggagatttagattctgataagcgttttgtcgccagtagccatggccctttgggcagactaacttttgtcagcctcaggttttctgttttgttaaggggaggtgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatatttatttgctcacttagtccttacagtttcccactgaatagaggttattattctcactttgctgataaggaaacagaggcaccgacaggttgagtatcttgcccaaattcaggtggcctgtaagaggcagagtcaggatttgaaccctgagccctccctgtactgcctggctgtgaccgccatcaccacagtgtgttctgctgggcttaactggtgtccaggcacttggcttccagcacagcactctttcccttcctccttctcgtattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaaggatcaccagggtcttgttcattggggcctgaagggcactggctgaatccactgtcggcattgcccacagatcaggagagcctgtgcatacagagagcctgctagagagccctgggtctaaggagaagcaagctccagggagaacaagtcaagggataacataaaatcttaatccatggaagcctagcaggaggctggacatgggctggaactcctgcttctcgttattaggaggaactgttgctctctcctttccgtctcagaaccagaggcaaaggcccagcctcttctgctgtgagtggtgtggaactaccaacctgcctcgtattaactgcaacatctataaagtatgagctccagccaatgctgctctagattcctctttcttcagagatgatgaattattgtagctcctagccctttcttttttctttctttctttttttttttttttgagacagagttttgctctcgtcgcctaggctggagtgcagtggtgctaattcctgacctcaggtgatccaactgcctcagcctcccaaagtgctgggattacaggcgtgagccaccgcatctggcccctagccctttcaatgaatttcagggaattgtgaaaattcctttgttgagataattgtttaaatataatatagttcaccagccaggcctcaaaaaactcagtatttctcatttccttatttagaaatagagctttttgtaatgtaaacaattaaaaaaattattttaaaactgcaactattggaaatgagatcagcaggtggtaaggacaaagcatttaaatctttccagtttatgcagcagtgacagccgccaatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 1158 - DNA, 324976 bp, Homo sapiens
tcttctacaaatgtagaggtttatttcaacaaaatgtgtaaagagtgcatctgaagctcctgctcatcacagtatgtgtccatcaaattctgagacaagtgaaggctgttttgtgaacgaagagaacagataatatggcggtctccgtccaagcaggtcttggtcaatatccatcatttatactcctcctgccttagtagccttgcatgtttgaggggctgtgggaatgtcagattgctcatgttctgtgcctccaacttgaaaaaatccttgtccagggtaagacctacagtaaggagctctggggatgggggaggaggcattacagggttctagagaggaaacatactcgtttgtgtcataatttggtggggagaggggaggtaaatgagtgtaacccaccctgcctctgaagacatgcctggacaggcctcctggggggtgcaggacttcataccacttgtagatatgtgggatttgatttattgcaaaaaagcatagaagaataatctggtcaaaaatgaatccaattcttactaggtaagcaaatagccagcaatggtcaatgcattttcctggactgagaattgtcccccaccactttatgcccttttctgaaggtgctgaacacctgtaccttccaccagggcagccgggctgaggctctgactcctgggggctgtccgctccatacccagccatacagtgcccacctgcaacccagaaccattgaaaagtccagccaatctatccgcacagattcctcctgaagaaggggaggtggagctcgttcttgtgtgcaaactacagggttaaggctcagaactgtggcttgtccaagaacgttcataccactgcttctcaaatgtcttagtgatttcctccttggtcatcagtgacaaatgcagttagctgcactaaaggaaccggatgctacaccagccctgatcacctgccactcttgctttaggaacagaggaatcagtaagttcttttcttgaataaactagttgttgaaagtaaactctctccaccacctgaggaagcccctgatgccagtcaggaggggccagtaagcctggaggacagcagcaccatgactgagttgtaaataatcttaaggtcatgtggattctgtgtttcctggaagcctccctcatcaggaaggccagctcctggtgctgagggtgtagctgtcaccagggtcctttcagagctgtggggagacctgctgcctgtctacactctggggaagagagtagaaccgttagctgctaggacagtaatcctggaactagggaagagtgagtgtggaggcaccattaacctctcaaaaccatccaagctccaggcttcataggaacaactttccaagtcctcaaaacaaacagactatctatctatctcactggctctccacatggcataaataactagtttccaccagtgcagaaagggcagttctcttctggctcctcctctgccaactcaggcttcaccacctgtggaactgctggggcccctcaagcactggccttgcagctcccagccacatgcgacagctagtccagcagtgacgtgcaggcgagaggcaggccaacaactacctttccctttgtcctcagagactgaacccaaggttgaggtcccctaaatcaagaataactggttctattttctttctctgcttcttggctcacagttttgccctcatctttgagttcctatggagcttgtagtagattttatgctctaatttttcttcataaaaggtaccgtagtgtggttaaactgggaatcattcctctccagtgcctactgtgtgctgggctaagagtcggggtaataaacaatggacttgaggcttcctcctctccttagccctcctctgctgcctgtggctgcggctcatggggccaggagtgaggggggctgctcactgctgggcaactcctcacgcttccccatgctgggaggccaaggggctgtcaggacaggaggggcagccctactttggttagtaagacctcatggtacatgtttgtacctttcattgccttctcagtcctgtgcagggagtggaggactaggcctggccagggtaataaatactgaatggggtaggtgtgactggtgggctggagggggattctgtgatcttacatcccaggatgtcatgcataacctgaaacgagaggaagtaaaatgccatttgactccagtgctgggtctcctgtgccttctcattacagtggttacagttgtaaaaggcagctctagcccttttctccagagacagggcagggacaggcaggaagctcttcctacgtggaaggggaatccattgtggagaggatccgtatgacttctgctcgctgagtgggtgatatgtgctgcgtcatatggatgatggaatccatggcaacctctggattggcctggaccaagctggaaaggaagattgagaatggtgaagaaaagagaagcagaagtgtctagatgaggacagctaaagaactgcccaataaacatgtgtgcaccgtccactgcagacattttagtcacgcctcaccttatttgtttccctatattacaaatatccagccaaggtagtgcaagacaaacccaaaacattttgctatgttgaaaaaggaattaaacccaaaacaaaacccaaaaaaaacccaaaacatgccaatgggggcatgtcacaaagacagcaattggggcatcaaaagcagcccagcaatgaattataaatcagtaaaaaatagaacttcatgagtctgtaccaataatgtatatataaaagaatcggcaggagtgaggactgagtggtgactggtaattgtggagggtgtgctggagttggaaagttatcattttgcaagctcatcgtaaagactgcaccagagggaaattttgatgaaagcaagatacttgcatggccttaaaatgtcttcctgcagactacttattaggtgcaaggggggaaaatcagtaattatacggtagagaaatggagcaacatcttgaccagcggatgaaattaacacgaggaggagcagataaacagcatgtgcccccagatgtggtgccctgtgaaggttctggccagagtgcctcacctgcatctcatcatggggagacatcagacaaactcaaaatgagcaatgttctacagatggtagatatcagataaaagtttttaatcaatgttaaatttacaaaagtggatcattttatgatggttatgtaaaagtatccctattctcagcaaatgcacactgaaatatttgggggtaaaggccatgatatatgtaacacccttaagtagttcagaaagaggaaaaatgtatacacatatgggagggcaggcacactcataagtgatatagcaacggggagaaaatgtaacaggtaaatctgagtacagatattatatataggggtgttctttgtactgtttttaattttataacttttctgtaagtgaaatgtttccaaataaacttttacaaaaatgcccctgcagtctctaccaccgatcctatggagcagactgaagcctctagaagaatacagctaactcttggcttcaggaggtgaggaggtggtttcccaggaaaccaccacacacacaatcagctttcctcccagagttgttcatccggtttgagtatcagcattcagagctaagaggtgggcacagtgaattaagccttcatctagctgagattactaagtgcccctggggagcagtagctgaaaaagaattgggcttcaggccatatctgtacctgtgggtcaactacagctgtctcaaacagcaagagactgcagagatcataagatttctgcgatcatctcatgatttgtttggaaactttttattccaaagaaattagccctccttctctagtggagttccccacgttggtctcacctgcggatttgcttgaggacgtagtctctgctgatgcatttgatgttttcctctattaccgagtgaacaccatcctcctctgtcagctgtttctctagccactccgccagatccttattattgtcccaaacataagcctgcaaacagatgactcttggtcaaacaccaggggtcaggccaggccgggacaccctgactattcaggatctggagtgcttgcttactccaaaagtgtgctccgtgtccacgattctccttcactgtcagcatcgtgcaggaggaggaagtaggcctcgaggcaggagctgtgccccttctccttctcttcctttatggacacaggtgtacacctgaagtctccatggggctctcccgagcactctggtgctcataccctgactctgtcctgtcagactctagggacccacctatttgacaaaggctaagagaattcaataacctgacaggtttgagagaaccagttaaaagcccaaattacttagtaaaattgtgattgagaaggcaaggctgtttatttggtgttttgctctcagaggagctgagacacaatgcctaaagtataagtctctagcctcagtgaggcctggcagtcactggatggatgaagtctcctgaaatagagcccactgtcttttgatgaggcacggacggggaactgatgggagggaagtcttgttgccagggtacagccaccaggtcagaaacctaagccccattttattacctatgagagtattcgaaaggatcaagacgtccataaccctgaaagtctcaacaaaccacctctcacctccttttcaagatcatttagctgagtatttcctaggtggttgactacataataattcaggagtgtgttagaagcctaatagccttctccttgctctcttctcctctcattttctttacaaatcatttaggaatcgttttgttaatggtttccggaaaaccaagtaccacaattagggctcattcatatttatgtcattttgtttgggtaattaaacacaaagcttgtcatttaaaggtgcgctatccttctctgttatcactaacgaagtcaaagtcagaatgacaatgagtttggtgctataatttaataggtgggtgtgtttgttagggactctgaggctttgaggtttgagacgtggctacaggaagcctgtatgcaagcaaggtcaccaaagccacagctgtgactactgggctgcagaggaaatgtcttcatcacaagaggcctcaagcagtacaaaactgagcactaggctattttctaactatctcgtgccttcaaatataatggtttcttttcagactgtcacttcctgtctctaacttagctgccgacttagttgtgactggttatttaatgtatgtcatttcatcgacgtctctgtttctaaaaattaactcctttacattggaaagatgaaggcttccggggactaaggatcagcagtatgtctcttttagttctttgtccatttctttttctgactcaaatgtgcccagttctgtatctaatcactgataagcagatcagcaattcttcagctggggtgtgtggccccgtcagtgcaaacctgagtgaccctctcctctctgtgcctgggttaggactcccagcatctctcaaggccaaactgccttgagaaagtgttttgcgcctaaggaaaggaagtgtcacatcagcccctatccacgagggagaaggtagcactgcttttcccataacatggttttaactcactcttgtgacccagcttgctgcacgccccacatatggatgggtccccctggactcctaaacgtcgccacctaaatttcaacatttccatttccatcattggcaatttactcttctgctccgtggtttcaggacttctacacatacccctacttatgaagattggggtggaggggaggaaaaataaaacaataaatgcttcttggatttcagaatggaaaaaaaaaaaaccccaagatttttagatttacccaagaatcccaaagcctttagtttaggagaatatttaatactcttattaatcatttttaatccgtttgcttttaattaagaaacagcatgatgctttcctatcaacatatgccagggagcagattaattgtggcttaagataactctccttgattggtgtaatgtattagctaacgagatgcctgcttccaacaatgctcagacactacactggaaagccagctaccctctagagaaaactcttctgccttcccctcctgcagccacagagtatgctaggtgtttaaacattttgaaaagttcccagacaggattagggcaacgcattccaagttttacagttgcttgaaaatatgggtcctataaaaagatctgctgtttacgcaaagtacaactggatgacaatgaccgccaaaccccagtggattacagcctagagtacatgaaggaaaggggtctcaagttctaatcaactgcatgtttagcaaaaataaacaaacttatgtaagcatagtgccactggtttttctcaacagacctgggagagttaccatactgttgtgggataatttgctccacctgggaaaagcaagctcccttccactgggttatggagtttacaggtttttttttcttcccccagacagggtctcctcctgttgcccaggctggagtacagtggcatgatcacagctcattgcagcccgaaactcctgggctcacgtgattctcctgcatcggcatcctgaatagctaggattacaggcatgccccaccatgcctggcaaaactttttttggtagaaacagggtctcgttatgttgcccaggctggtcttgaactcctgggctcaagcagttcccctgccttggcctcccaaagtgctgggattataggcgtgtgccactgtgcccagccagagcctacagtttcttgtttgctcccttagaacagttgtaagactcaattccagtcatccagaaggataggccaaccttattcccaggaagaagccattattatttccctccttaaaattatgaaaatgggcctggcacagtggctcacgcctgttatcccagcaatttgggaggctgaggcagggaattgctggagtccaggagtttcagaccagcctgggcaacatggcaaaaccccacctctacaaaaaaatcagccaggtggggtagtgtatgcctatagtcccagctacttgggaggctgaggtgggaggggaggatcacatgagcccaggaggttgaggctgaaagtgagtcatcatacctactccagcagcctgggcaatagagtgagacaaaaaaaaaaaaaaagaaaatgtggccagtcattcctagtattccagcgtggactttaaacaggtgtgatatgctaggctgctaacatcatgacaggcctgggcccgtatgccacctgtcagcatatccatctgtatcagaacattttatcaataaaatatcaataattctacatcacaacagtggcctgtcctaaaatgaatgttcaacagacactttctgtctgcatcagtggataagtatctcaggcactagtcagcctcactaattttatgtagtaattagtctatctcacaacatctaaatgacctgtttggaaagtttcatttctaacatactggatagctgttaagtcctccttagacaatggttcagcagggccaaggagtgaccagggcacaacctgatggatgtgagccctgattactataccctactaataactcaccttgggagctgctgggagacacctccagctagggaggctcctcccatttctgaccttctagacttctgggaaacacacagcctgatgggtgtagggatggcatacaaatcctaaggtacactcatattttggaaagacattttcaatacacctacacttacaaggctaagccctatccaacagaagcccaagaaaggatgtgatttttttttccaagggctttagagtacaatagccaaaggacatgtgggctagggtggccatcagacccctgtgaaccaagctcctgtgagccaatcccatctcagctccaggcccatagcagggccaagcaacactttccaggttctaccttacctcctccctgcctggccctgtgtgagaagtttggtgtatgagacttattcatcagtagcctgaggccaggttttgaggtcagtggaaataagtgaccctgtcaatagtgctttttcctatggtcctcacaggggcctctgttgagcattcatttcacttggaaatccagaataagagcgagtgggtagctgtgtgaacaataagaatgcaccatggcatcgggttgtgggaacatgagagcatgccaaaccaaagagcgtctgagcacccactgtgctcaggagtcagccccctttccgccgaggtcaatcagctgtacatttttgacttggtctatgttgctattatttttttaccttctaacatggagcaggggaaactagcatattttgaatgtctactgagccagacattgtgttccatactttttctttttggagacagggtctcactctgttgcccaggctggggtgcagtggcgccatcatagctcactataacctcaaattccttggcccaagcgatgctcctgcctcagccccctgaggagctaggactacatgtgtgtgccacgacaccgagcaaattttaaaattttttgtgaagacagggtcttgctttgttatccaggctggtctcaaactcctggcctcaagcgatcctcccacttcagcttcccaaagcactgggattacaggcgtgagccaccacatctgacttatgctccatactttactcatgttatttaaaactcactgaaccccatgacataaacaccacccccattttacagatgagggaatggaggcttaaataatatgcccatgccagtaaatgacaaagctgggatcccgaagtttatgagatttcaaaacccacattctcattgttccatgcagagtcctaatttcaatttctactattggggtctgggaaaaaataaatcagcctgtttgaaaaaccaggcttcaaattttggatctaagaatcaagtgagaaaccatgcccaggatacaaatgtgtgccatgttcttatgacccaatttaaactactgttcttgttattttcgttaaggagctgtagtgatgctttgcttctgcctgcagtgaaactatgaaccataaatcctactatttcctacagtaggatcgtcccagtggattcaaacagactcccataactcatggtaacagatatctctaagggaaacaaaagaattatagtgctcagttatataatatcaccgtgtcttcaattttctgtcccagaatttctgttttcaggattaagattaagaaaacaaattctctgggaacaaaaagaacacaaggcatagctaatagatgcctatctcgaaatgtcttttcttaccagtaaccaaccacaataaggattagagggtcacttcctggtgcaaagccagggtctagactcagccagtctttgcacttgagaaacacaacacacagtatctatcattctttgaagaaccacccccccccccccacaccaaacagcaagcagattgtacatcactccttctgaggcacacagatggcttttgaacactgcaaccctttcttctctcaagggcactgcagattttatcacccacctcacactaaactaggtcctgctgagcctgccgaatatggaaggaggtttcaaagccacatgccctgacatcataggattacccgtcctcacgttcagtccttggcattcctctcagagaactcaggagaatgctgccttttgtagatgggcacaagggaaatggcctcagtgctcagcatggctgcccccagtgcctaggcagcctcctactgagctacggggtggaggttctcttctgtgcttcaattccagccaggagcttgtacacacgtggtcaactgttctctccattgataagagacggcagtgacctatttcttcagacgctctgtccgcttgggagcaggatgctagggaaaagctgaagggcctatctacttgcttcatgcctggggggaaacttccttctcatccttgtgcctactgaggctggacacgtccattagtgactaatgtggtagggaggcagtgcaggcctctcctggccacacacatacacacacactccatttacctagccggccactcttaactggaggacaaactcttattttacacttgcgtgactttcaatgccaacttccactagaagctgccagtagccactgacaaaattgtctcactcaattatgatgccacagactgaccttaacctgaaccaaatgtcggagaaggctgtgctccccaactgcacatttgaaatatttatccaaagaagcttttcagtcataaaaaaaatgggcagacttaatacaaaggtgaatcctagaagcaccccaattcactggctttaaaactgacagcaaatctgggagctcctccttgagaacgattagcagaggcttcaggcaacactttctaggcagaggccagagtgcccctctttgtgggccaggacccttcaagccaccaccagccacccagccctccatcaatactctaacctggtagtcaccaaatgtttgtgatcacatagcaatgagaaagacagacaaatatattttgagcacatactaccaatattctgataaaatgcatttttgatgtaaatgattaatccatatattaattactaataaaggttaatttctttttgttagtaaaaataaacagaaataaaagttccagctttttcttcccatccatggagtgacttatgcagcccactattccaggagcaaatgctggtgcccttgctaggtcatcctggcttgagacccgccccatccccaacactgaggctagagcaccaaggacaccatctcagtggggttactgctctaggtcacgagccctctctgtgagatcaccccaagaaaatgccagcttcataggtccctttccctgcataagggtggatacttccttccatctctgattggaagtaggcagctctttagttgtagtcatggcatctcctgccgatcacaacctgttaggcttctgctcttagcccctccaattccctcctccacacagcccccttagtggtctttctaaaatagaaatcagagcatgtcactccactgcttaaaatacctgagtggtttccgacaggcctcaggacaaagtccaaactccttgacagcttacatggccctgtgtgatcatgcccctgccccttcttcctaccaggcacccagtctctgagctgccctgaaacagttgcaggatgttcctttgatgcatgttactcttactctcatggcttaggatgatgctgttccttctgcaggaacattcctcctaagccctgactgcccccaaatccagccttttcttctggttcatttctgctttgttttccagcctctcctgagacatcacttactgcacaaggcttcttagactctcctccatccttcccagagagggtcaggtatcttctcgctgtgctctgtgccctttgctgtgtttaacatgggcctcactattgtgcataacctctttatttgtctccccctctagatggtgagctctatgtggataggaacaacatttgcctctttcactgccatgcccccagaagcaaatgcagtgtctagtacccagtaagtgttcaaaaaggtctgctgaatgattgcataagctgcaacatatgccctaccacctcttctaacaagatgtcgtgacatgacatgttagggggagtagctgggggaggaaacagcttggatctctatgtttcccttctactcctgcccttagaggcctgtggactctttgctggcgagacttgcagccctcaggtggtgtgaggaactcagcaaaaaggcttctctttgagtgtcccacctaccttcactgttccttccacttccacaaaccagcgccttaacatggcttgaatctggccatcagtcagctcagggttggcattgtggattttcttcttgaccaggtcctccagcagaagacgcctcagccgccagtagaagaaggtacgggatgttttccaatccaggatatcctacatgcagagaagaataaacttagcccagtcctaattcctgcttaatgctcagtctggagggaaacccacaggcataaaaactgattctccaggcaagcccttcacagacccaagagctggctgtaaactcctagcacttccagatgtcccccagggcagaaatgcagcccacatgccctgctgtctgcagcactgtgcacagccatgggcctggctaatgctgatcccacacatggctgagatgttctggggaagaggctgtgagttcccagataaccagacaaggataaattcgttttgagaagatggatcaaacaacttgcagatcaattattaattagctgctgcgggagccttgaccctatagtaacccacatcctgaggacccgtcaccaatgaagtcacatgtgactcagtttcccaccagtaaaatgcagcttgcctcctgaggaattaatggaaacctaaattatacattgttttaagatgataacagttacagaaacagtgaaaatctaaaaaatattgaaaatgttttgatctgcagaagttgttttaatttggccctcatagctccctgcttatgagcctgtgtgcaacacacacacacacttgcccacatgtgggcctctgacaagaagtggcaaccattgtacttacgctaataacacccttctcctgcatccggcctggtgtgtcgtgcaagtcagcaaactgcacggctacctgatggtaaatgggaattaggaattcctcccgctccttcaacttgttctccaactccttccgctcagctgtgcttagctctggggtccctgcaattagataaacatgcccgtcacactctgtaatgaccaggaatctctctgcacaaaagcagccacaatcacgggaagctcaacatcagcctgccccctcttccctctgtggcctggctctccgttgtcttctctgctctttgctgattaacagggccctacaagatgccacaccagtctttaccttgccacaagaagcccacatgccctcttttccctgtggcagtcacaagtgtgaaggcagatggcagcccctctcccatgcctctccctgagaaggtgcaagtagcgacctagaggcctgctgcatattgctgacaccacccaggctcctccttcccctgaggccagtacttgtacactgacaccatgcccatccctgctgaccagcatcaaagcagctgggctattccacacgtgggatgtggtgagagcacccctaaactccgagcacaaactagtagctcctgtttccgtgtacatgcgagttatctgccaaacttggcaaggacctgaataactcctaaagttacaagccatagtacttcatggcttctaatctcaggtttatatactcttaacctctaattagtagaactcaatctaattagagctagatcctcacatcttgtgtcagctcagtgggttagcctgtgctctcccgcctgggctgctactgccagagccagtccctgaccagacaaagacattctacttcttaggctaaaggagaaggaggatgtaaaaagagaaaggcagttggcaaacctcatttggatcactgcgcacggtaccctgactcaacagacaggagactttggaaccccttataccaaggagggacccctcccccaatcaatagtgtcccagtagaggtgttgctatggtgtgcctttcttcctaattactctcagaatgggatctgcaatcaatactgaaaatttagctgcctgcctagtaaggaggagtaagcctagctgaaggagcaataggtgacagcccctggtgttagggacaccctgaagtgctttgtcaccaaagctgacaaataaatacatgagcacaggtgataggatgcagaagaggaaggtctatttcaagcatgcctgtctgggaacaggccttgttttttacaccacaatgaatcatatgccataaaaacagccttgggctgctgactgagccgtattatacataaacacaggttaacagaggagggatgtaactatagtacttaagtttcatttttattagttttttggatgcccaactctacctctttttttaagctcatcaccattttaaaactgtgatgaaggtgccactgatctgctgctttaggccccggcgcctcagtagtgttccttccaaaacacctgaacagcatgaacgcaccgggccccacactaagggatgacacaaaggcccattgcattctagtgtagatctgcctggagggctgatggcgggagggctgagggatggagggctgatgggaggagggctgatgggaggagggctgatagcaggagggctgatgggaggagggctgatggcgggagggctgatggcaggagggctgatggcgggagggctgatggcaggagggctgatggcgggagggctgatggcaggagggctgatggagggagggctgatgggaggagggctgatggagggagggctgatggcaagagggctgatgggaggagggctgagggatggagggctggctggtgtcttcggagatgagacattctcagaacacccttgttagggaagcaaatattttcccttctccacagaaagaaaccaagattccctggagaaatagctgattctagggatgaggtagggaaaacatcagatgaacctggggtatattgtgacaaaaaaacaaggaagccctcaaaaaacgattgagacatgttagaaaaatgcaggagccagttttgaatgtgttcccactgcccaattctgggacaatgaacactaaaataaataatgatatttattaacagacagaatatttgtggaatgaaactagaatctaccaattcaccctcatataagtaattaaatgagggagaagggaaagggaacactctctcttccagcagaagaacaataagtgtagcggaaatgatggaattagaaaaatcaccgttttacaagcatcactgtaaattactcttccaagaatcatcaatggatgtcaaagccagtgggtgaaagtttgataagaaacagaatattcacaaggtcttaaaatattccttacaaatcacttattaattacaaaggggaaaatggtaactttatcgtggattaacctagtgaacaacaccttaagcaagtaattaaattatcaccaagaggacagactgataccatgactcctgatgatgtactgagaaggacagaacatgacttccgcaacattcctgcccaaaaagcagaatcgaaatctaaccacaaacccaaactgaggaaacatgctacaaaaaaagtggctcactcttcaaaaatgtgaaaaacatgaaaaacaaaggtcaaagaatcagtccagattaaaagagaccaaaaatacttgacaatgaatttcaatgtatgctcattagatcagatctcagaccgcccctcaaaaaaaaaaaaaaaaactaaaaaggacattgagacaattggtaaaattttaatatgaatcatggattagacagtagtatcaatgtttacagttcttgattttgataaatgtattgtggttatgtaggagaaagtctgtgttcttagaaatacacactaatatttatgaataaagaagcattagggccaggcggggtggctcacacctgtaatcccagcactttgggaggctgaggtaggtgggttacttgaggccaggagtttgagaccagcctggccaacatggcaagaccttgtctctactaaaaatacaaaaattagccaggcatggtggcacatgcttgccatcccagctactcaggaggctgaggcgtgagaattgcttgaacccgggaactggagtttgcagtgagttaagatggcgccactgcactccagcctgagtgactgtctcagaaaaaaaaaaaaaaaaaaaggcaagaggtccacagattactttcaaatggctcaaagaaaatgcatatgtgtgtggagcaagagagaataaatacatgtacacatgtgaatatgcagaaataataaagcattgggatattaacaataggtgaatttgagaaaaaagcattgtattattcttgtaacttttttgtgaaattggaaagttttaaaaattaggcaagctggaaaagaaaacttattcctggctatccaatgcatacaatcaataatcaaagctaatatttatagggtactgggcaccattctaagtgctttatatctattaatttattatcacaacaaccttaggagtctggtattcttattattcccattttacaggtgaggagactgaggcactgagaatttatggacttaccaaggtcacaaagctagcaagtgacagagccaagactcaaatgcagcagtttgggtcccaaagcttttgaacactgttagctgtctcttctcgcttacttgggcagaagacacgtgcttcagtagtagtgtccctttaatttctgagaggctaagtgatgatggtgggctcctggctgataaaggttctatcttagtcccaattccataactaagaccaggacaatgtctccaatagttcccattcagatgcaatttcctaggcaggcctaagatttaagagttgtgtctcttgttactgtgagttcaagaactaatacaataataggtaaagtcacagccctgcagggagcaaagggatggcaagaccactgacatggctaaacgcacatatacatggaccatatctaacacaccatttattgagcatttaccactcactgcactcaaatctttcaggatcacatatcataatcaccaagcacaatacagatctacacacctacatctggtcagctgttaacactgctgccaagctgaatacttcaacgttactgcgtgctttcccagttgcttcaggtacatgatctccaatccttaggacaactcaactttatgccagggtgtctattttacaggtaagaaaaccacagctctgaaatgtaaagggacttccccaatggcatccagctctttttttttttttttttttttttgagacggagtcttgctctgtcgcccaggctggagtgcagtggcacgatctcggctcactgcaacctctgccccctgagttcaagcaattcttctgcctcagactcccaagtagctgggattacaggtgcccgtcaccaagcctgactgatttttgaatttttcatagagatttggttttaccatgttggccagactggtctcaaactgacctcaggtgatctgcctgcctcggcctccaaaagtgctgggattacaggtgtgagccaccgcacctggctgcatccagctcttaagtggcaaagtcaggatttacacttgggtctggctctctccaaagcctgtgttcttccacattaaatggtattgaaggctggcaagcagatatcctgcagtggccactatagggaaaccagctggagagttggtttgttgttcgcaaggagttaagagcaaggctcagcactggctgcagaagagggagcagctacgggctgaggacagtgtttcagaaaccaggctttggcttcgccaagttggaaggacggaggatgctggcttctgggctaacaaaggtcttgccctctcaatcaagctattctagagctttgaaagaataacaaaataaatgcctgtaatgctctggccctcctgagactaggaagattgcagggcattcctccaaagcctaccttgtttgattccttcagtaatgcctctgattatggttcaagacccacctcaaaaaagcatcaaaacaaggaaaagactgaagtggagaatatatgtgtttttaaatgcccatgtgaaggtcaaggatttgtgtgctttgttttaggggaaaaaagatttttaaaattttattttctaaaaataaaaggctgctattaagccagttatatcatgtgttgcacaccgagggcccctctctccttgtacagcaaagcagccagccccggtaatgatttaggggagattaacaaatatgtcaatgtctattttctgcttaatttaaaagtggcgtctataaagatttttgacttctgaaccctgttctcctgaaagaaagaaggtaagaatgaggagggggataaagagtgattatcctatcattgatcgtttgtcaggagcatttcttattcactggactattgtaaaaagctaagctctcgatcaatgctgtaagctccctgtacaattaaatatcttgaaatggttttctttcttttctagccagattgcagggcctcagggattttaggaaagcaagttggtgtgtacacgtgtgtgagtgtgtttaagaatatgctacagagagaaaagtcattcttttctagaattctacattaggaaatggctgagtgggagtaaaaaggtaggtgctcccatcctttcctatccaaaataaaaagtccctatgcaagttgggaggactgcctgaagccaggatttcaagatcagcctggacaacaaagcaagaccctgtctctacaaacacacaaacacacacacacacacacacacacacacaaaatgccaagtgtggtagctcacacctgtaatctcagaactttgggaagccaaggtgggaggatggcttgagcccaggggttcaataccagcctgggcaacagagcgagaccctgtctttcctcctgcatgccccccaaaattagccaggcatggtgaagcgtgcctgtagtcccagagatactctggtggctgaggcaggaggatcgctggagcccaggagttcaagctgcggtgaactatgattgtgctgctgcactccagcctaggtcaggagtgtccaatcttttggcttccttgggccacattggaagaagaagaattatcttgggccacacataaaatacactaacgatagccaatgagctggaaaagaaattgtaaaaaaaatctcgtaatgttttaagaaagtttacaaatttgtgttgggccacatgtggcctgcaggccacggttggacaagtttggcttaggtgaaagagggtgaccttgtctcttaaaaaataagtccccatgaaatcctaaaaatgcacacttttaattaaaaaatttaaagagttaaacagagacgaaatatcactggtcaaataagaagagctaacactattgagatgttactgtgtgctggtactgttaaagtactttttatctcatttaatccttacaacaatcctaaaagatgaggaaactgaggcacaaaaaagtaactcacccaaggccacaaagctaggcaacagtggagttgtgattttggactaggtaatctggtttaagagcccatgctccttaaacaaagcagttcaaattgacttgaaagtatccgcagcacagtggcctatcaggtgttccctggagccaggatacaaagaaaagccacatttctcctccatggtatcaaaggtgaagagaggctggacacggtgggtcatgcctgtaatatcagcactttgagaggccaaggtgggaaggactgcggaggccaggagtttgagaccagcccaggcaacacagggaaattctgtctctacaaatattttaaaattagcggaatgtggtggcgcatgccttgtagtcctagctacttgggactgaggtgggagaattgcttgagcctgacaggtcgaggtgtggtgagctgtgatcatgacactgcactccaggctggcagacagagtgagaatctgtctctgaccgaaaaaaaaaaaaaaaaaaaaaagctaaagagaaactcccagaggaaacggctgatttctgcagcaggaggcaattttttgcccagccatatcacttaaataggccaggagaaggtcagccctagtctgtgtatgaacaaactacatcctaaaagtaggatttgggggaggtgacatcttcaaagcttggaataaaaatcagactggtagactaaaaattctctgctcagccaaaggctctaggcgaccttgtagaaatctttttccttttctgagttgagttcctcatttatgtaacaacaatcccagtctggcaaacagggaaaatgttttataaaagaatgtgatattaaagtgtttttaaaaacattctcaacttttaaaaaagttatacttggtggcaggcacctgtaatctcagctacttgggaggctgaggcaggagaatcgcttgaactcgggaggcagaggttgcagtgagccaaaatcacgccactgcactccagcccaggcgacagtgcgaggctccatctcaaaaacaaaaacaaaaccaaaacagttatactaagaagcctatgtaaatttaaatccaattttaactttgatgggcccttcttcctttacttaagaaagcaatttgcgccaggcacggtggctcatgcctgtaatcccaacactttaggaggccgaggcgggcggatcacctgaggtcgggagttcaagaccatcctggccaacataaagaaaccccatctctgctaaaaatacaaaattagtcgggcatggtggtgcatgcctataatcctagctactcaggaggctgaggtaggagaactgcttgaacccgggaggcagaggttgcagtgagccgtgatcgtgccattgcactccagcctgggcaacaagagcgaaactctgtctcaaaaaaaaaaaaaaaagaaagaaagaaagaaagcaatttgctttgaatggttcaatacttatgatgctagagataagaacaagaccaccctccccagaaagctcctgaatatctcagatgttaaaacatactcccatccctcaaccttgagactgaaaaatcagcataaaaaagactggaatcttattaagattcagaagtacaaacacaagcagttgtttaaaagatctatgtaatcacattttctatgttgaaagaaatttttctataaacatagtaagataggtaaaaaaaaaaaatcctgcaaaactatttctatatccataacaggtgtgcctttctttacacaaaagcattcttgaaaaactgcgtaaatcagatcctgttttaaatgccttaagggagctattttatgaggaaccctgcagtgaatcctttggtaaggcaaataatccttttgtaatgggaataatttctcccaatgtatctagctttttttaaaaccccattttcatatatctgcttttcttcaaagggggccatacctatctaaatacactcacatttgcatattgattttaacagcaatcctctcaggggatgtttaaccctaaagttccctgcaacagtgttagtgctctactgttcatatttttaaaaatcattatattaatagaaaacccagagatttccaaacaggaataaaaaaaaatactgctcccccatcagtcccgtccctgtgtttccacgcagacatatccatataaaaaaggtcagggaacagcacagaattctctgaattcttctggtagaaatatgcctctgtagtcttcattattttccttccctaatttgctctccctatgtctggcaggtcaggatacggggatctggtcatttgggaccaagacacattctgatgacagctttctcttgggttccctctaactaaatgcctgccaggtccctctggccatacagaattgtgaaacactgcttccttgggggaggcaagcccaggtgcttttataaatacaatcagattaaaggatcaaactaaaatgacccctttctcttctcagaaaattttgtcactattgcactaaacttcaccgagccaaatagcttctgaatcagtgtgaggggtaggttttcagctactgctaacaaaagagaggaggcaagatcccatatctaccttcgtgatagaaagcctcgtgttatttctcatcagcctccttaccgcaaaggacacagtggccatagtgtcagtgaggacactccaagttcaacaggtgagaggtgaaagaccactcactaaggcatgcgtatcggaacttctttctttcctagtcttaactttccaggcaaagacatactttctgcctcaaacaagcaactctggctcttttcagctttcagcctctcgaagatggacataagagttggaaaaacacagctcagatactttgatcacctctgccagaaaagcagcttaacccttaagtccccttagcccagggaacagtccttttcctgtcattctggctgctagagaaggcttgggaggaaggcattcctgaagatttttacagagaagcgtatcctcacctgccaccacaatgctccatatctgcacctggggcaaccttgaccctgaaggcatggtgggtgtgggcaggcctagaaggaccaggcaagggccagcagcagtgctcactcagtccatgctgctgctccctgtggcaggcagtcagggcatgttctgtgtgggcgcagtgcggtgctgcatggcaggctgcccagctgcctgggaacagggccacaactaagaacaagttcccctaagcggctcctttgcccaggtgctcttcattttgagagagagggacagtggggaacttacaattgcttcacacttgggctggacagttctctctccatctaaattgatttgtcatttctctctgaacacaagaggaggggaaggatccaggagaggacctcaggtcacagcactcaagaggccaggctagcaaggccgtcccgctccacagccactctccctgctcctggccttgtgaggcagtagaaggatgtcagagagagacaaaaaggacttggagggctgcggctccatttccagagaagaaatttaatttccttaaggcaaccaaatggtaggaagtaattctcctccttgcaatgactctaccaagccctggttctgtgaatcagggtcagaactgattcagcaatgcaagactctggggcctgggctttgctcacttttctttctgaggtaattcttccctttacttctattaggaatcagtgtaggcactatttacatattttctgttataatcacagacctgcaaactagtaattcaccatctttccacccaaactaaccatgtaagatgacaaaaggccatttaaaaaaataaaaattctagaagagatgaagttagctgctcagaagtcaaatattactcattcttataaaatacatagcaattatgattttttttttttttaaagacagggatttgctcttcttgcccaggctggagtgcaatggcgcgatctcggctcactgcaacctccacctcccaggttcaagcgattctcctgcctcagcctcctgagtagctgggactacaggcatgcaccaccatgcccggctaattttgtatttttagtagagacggggtttctccatgttggtcaggctggtcttgaactcccaacctcaggtgatctgcctgcctcctcctcctaaagtgctgggattacaggcgtgagccaccgtgcccggagtaattatgtttttgaacacagtcaatcagttgtgcgctggtttgtctaagtgatctgtgagcacgctccccagtaaagaggcagatttggggagagaacggcaacacaagataacatccactcctacaggctttctcctaaatcagattttctctgtggaaatggctttagattacaaaaggaaagaatccttgtttaatttagttcgggctcagtattcagttgaggaaaaatctgaagaaatcctgagaaaaggagaacacagagaatgagaattccattctggactctgatgtacatttatttattttgtatcttagatgattcacttttttggcctcaatttcccagtctgaaaaatgagaccattttcacccactttgtgaaaaagaattttggtagtttggttctaggcaaactaaaagagccagaatcattgtgaaccccaaaggaactgggttcataatatgtcctgttatatctaggctgacctgctttgtcgcagagacagctgcccgtataggatatccctgagagacaggactatacttctgtttctttcatattttcacatgtgggactgagccacagagaatactggataccaaacatggccatctgctttttctaatgattaagacagaaagataatgatgcaatgaagtaaatgcatgctcatctgctcctcatattagctaggcagaggtgtgatctccactttatggttggaaaaaaactgatgttcggagaagttaaataatttacaagactcgtagttcgttattcttattccaagtccactgctcatgttcccaagctgccctaggccagagcctgcttcacatttagcagactaagggtcctttttcaagtgccattttggtcaaggttaaataaatatggttttctccaatgcggataggaaattgataatgagatgatttgtaacaaatgattaaacggctatcacttgggagtctcctccctctccccttcatgtgcttcaaaagttaaaaggtgctggttgaaggtgggagcgacatcactttccttgaagagaaagaagctttatctccacacccctcaccatccagtccttctgcaaaaggagaaaggatccctctccctaccacccagttactctgaagggatgataacagccattggggggttaaaaagaggcagtgaacccccagttaatgagtaggaattcagcaggcagtgtaagataaatggagctctctctgcttctgctagagtcagcatgaactgcggccctgcggcttgtttgtggcaaatggagtgcgcgaaatatcaaagggcagtgatccagaagaagaccgactttgacaaattttaaattggccagaaagaaaaccagcaaaaagaaaaaaaaaagggaaaagaaaaaggaagaaaaaaaggaaaaaggaaaatgatgcaatttgctgtgtcctgcaattgcggcattgctgcctttgtatggaattagtggtaaacacagcggcaacaattgggggatgctgggagcaattatgagccatctaagtgagatgcttatcagtggctgaagcttttagagctctctctatgaacagttgtaagtaacttgctcttgagctgcagttactttaattaaagtgtacagggttggtcagaagtaattattctgtttggaaaagaaagagaaaaaacccacctcaattctgggtggcaatagattttagaaacaactctcatttcttgtatgtgtgcattccccataaaaggatcagactgtggtgagttagagttattggtggctgttacccagtggcaaacaatgggacacaaacagggtttcttgtaacccaagtcaccgtgtttggcaggcaacctggctcagggctccaaatgcctggatgtacagtctccacagtgtaggcaaacgggatttttctgtctctggatggtggggatatacagtccacaaatggtactttattaattaaattaccacttggaacataaatgagctagcatctctcttctccattcactgagtttcactaccttttaaaggcaatctctgttcctttagaaaaaaacaaaaacaagacaaaccaactgacaaaagaacctcgagcaattatctttactaacatagcaaggggctcaatgggagacctgggcagaaaatcagtgttttaaaagaatctgaaactcatttagactctggactcaacacaggactcccatggtttagtcctatgttcaaattgccaagtggcttccaaaagctctgaaaacaaatgagcaacagagcaatggctggaagcattaagcacgcctgctctcagggctattctggctgcagctactgtttggaagcacacagtgcgcaatctttacttctatttctctagctcaggaagaccccggaacaccacctgggtaaagactcctgcttttctatcccatctctcagaaatgaagtgagctgtccaaagaaacaagcagaaacaggacatatttaaatctagcatattctctggtgaggcctgcccccagcagcaactctagctaatcattctctacaaggacatcttagaaagacgggctttttgtactctaaggaaatatcaggaaaaaaaatcaggtgacttttgcttttttagggctcactttccctattatacacactatttcattctaccagggttcttaccatatagaggacagtaaataaagattatcatgaatttgatcaaatgcttcagtgcctcctcccctggcctatgaatgcactcattacaaatcagctgaatggctcattgatttgccagaaggacaagcagacatacccaatcgctcagccaagtggatgtagactgggtccacccgacgcatggttttcaccagatcctttctgcggaatttgatttctactgtcccttctggctccagaacagatcccctggatcagaaagaaagaaaaaacaaaacagaaatagaggcactttaaaggaaggagacaacagaatgaggccagttacaatttgtagaccaggaaatagcttcattatcattttgcccacctatggttaacagacatctccccggggagaacagtaggcaccagagaagtgtctaagtgaggtatgagaaaggcctggcaaaaagcaattaaaataattctcattaccacaccagtcgacttccatttcaaagggagaagaatacagattccaccacctacagctgataagagtaacaggaatcacattattttccaggggaaaaaaatgctgtaggcacagtgacaggggaaccacctccatcacgtaggatgtacaataatgaagggcaatacttcatcaatactatctatctatctatctatctatctatctatctacctcacctataccacagctgtcagtctgcttgtaggacactgatcagacacactaagccaggccaagtaggaggtaaaacattctgcccagcgctatggaaatgagcagagtcaaaggtctcagggttacttttagtgcatactaatgatgttcagtccccagaaactttaccccaaacatgtttaaaaaaaaacccacagctttctagtttaaaaaaattatagataatgtttactatgtacatggcactgttctaataacttacatataaatccttacaacaatcctatgcccagtctccatctactatgtagtaaggttctgtgattattcccattttacaggtgaggaaactacagtttagtaagttatgagactcgtccaaatataacaagaggcagaactggatttgaaaccagacagtctgattccaaagtctatagaggaattgtctctgatctgatatcagatgagtttaggacttaaaaaataataaacccctaagtacagaatgtaaataataagcctctcagcctagaggtttgacagtgaaactactggactctcctaagcagcctttgacatagaaggctgaatctggggggacaagagagaagcgggcggtccactaaaacgactggaggtaagaatttccttggaaaatgtcaaagaaacacgttttgaagtttacttaggaaagaggtgagaacagactatgaaaggatgccagattagatctgttttatttaggtagtttcaggtaccacctcccaataagcctgaggttctcccttacagtttttttgggtgctacaaacaccatggtcttcagcttcctgaaatgctagagtgaggacctggactgtaatggaaggaaaaagctttggtttggaatcacaggatgtgggtgctgtagtgccatggctgtaacattctccaggaggaaaccaacagctacagggtccctaaaggcagtgaatggaaatgtggaaggcacgctacctgctttctcggtcagcatacatctccatgtgccgggggttgatggaggagtcaatcaccacccaggagccaccccgcagctcagcctggggaggaatgtaaaccagcacaggctggcagcactccctcaagccatccacaatgtaagcaccaaacttcagcacttggtcgtacatatctatggagaatgagacaaattagaaatcaagaaatttctcttcctcaaagcagtacttttaaacactgttcaggacctctggccacgaagagcctccttatactatgcctcctgtttggccaccctatagactaaagggagtatcgacctgtatcccattcaagactccagaggatcttcaaaagcacaagacagcaacagagagatgcactgtctttcacaagatacagtgtgtaagtcttccagattgcctttccattttatatcctctctgaatttctgtactcacgtttcaccacattaattcacatttgctctacaaacgttgagtatttttcatgtcaatatgtgctctcccactacagtaagtttactaaaggaaggaactattctacctcttttcagttattctcatgatgcttagcataggatgagctcttcaaatgtgcacctaatggaaattgatcctttaaaaattttatcttcaaaaactatttttcatcttggtatcccgatatccctgcccagtgcctgaacatagttagtgctcaacaaatatctgctgaatgaatgaatgctgaataaattagttatatactctggaaagaatataatgagaaagaaagacaaattctttaacagttgcatttttatagggtatcaatgagagaaaaattttaaaaatacttaggaaataccacacagccacatgagaagaacagacccaaccagggcagcatagtgagaacctgtctctacaaataataaaaaattagctgggcatggtggtgcatgcctgcagtcccagtcacttggctgaggtgggaggatcacttgagcccaagaggtcgaggctgcagtgagccatgatcttgccactgcactctagcctgggtgacagaacaagaccctgtctcaaaaacaacataaaacaaaataaacaaaaaacaagagaggaaccacctcttcattctgctaaagactacactttgtagactgggaatggtagctcacacctataatcacagctccttgggaggctgaggtgggaggaccgcttgagcccaggagttcaagaccaacagagagagaccctatctctacaaaaaccaaaaaaattagcaaaacatggtggcacattcccatagtcccagcaacccaggagggtgaggtgggaggatctgagcctaggaggctgagacctgcagtgagctgtgatcatgctgctgtactccagtgtgggtaacacagcaaggccctgcctttaaaaaaaaaaaaaaaaaaaaaagagtacattttgtaatccctccaaagccaggagcagcctgaagaaaaggacccatgatgtacacataaagtgagtccctggaaaactggatcagttatttatttcccaactttttatggacttcccatttcccagctcactgaagtccattgctaaagctttaggtttatgagtccagatgtttaatgagtacttcagtggagccacaatggatcctttctaaataccaaataacaggttcaactgagatcaaactttcttatcaaagagaggatctcaatttggaataaatcaattctgggaatccaaggcaaagaagcatttttcaggaagttaagagcaaaccaaatagaaattgctttcattgtagttactggcaaattaaactgccaccttctccaaagtaaaaatggcttaatatacaaactatcagtgagcacagttcactgcaaggcacatgctccactgccccaacctggtgtgtctgtgaagacttcagaaattccaagttaccccagaaaacaccccctactctatgtggaatgtgtatgatatgtactccatgtatatgatcagagtgaagacatttattcctttgggagaaaagctaagaccaaaaaaatttactgctaattaacaactgctgtatgaagagcagggaataaaggactttaagtgctttacgctaattctgtagttatgaaaataattgctcagttcaaattattttaactaaattaattctttagtggatatttcaaccagtgctacataataaaataattgtgtaattagcagtacatttttcagtgctgccaagagtacagtctccgaacaagtaacagaaaagtgtccctcaatgatatcatacaaagagaggaaatgaaaggtatagataaaaggagaaaataaagcaataaaagacagcacaaaaagtcattctacctgaaaaagaaaaaaaaagttagaggtaagtgaagacaaagtttccagctcttttactcacttcttcttgttaaagacttagctacaacaaaatctatctctgtattataattaacagattgacatctcaaaaagaaggggagattttatttaaaatgtattttcattcatctattaaaaaaatactagatttcatagtatatgcaaacagtttcaaatgaagatgagtgtgtgtgtgtgatttttaattttatgaaatggacgtgggctcctttttgtcatcatcatggctagcttattgtgtaccagggaacatgattatatatacacacatataaatcatttaatcatcagaacattatcttatttatatatccaagttgcaggtgagtaaactgaggcttaaataagagtgagtggtggagataagactcaaatctagatcttgttggccctaatgtccacattctactacttcattcttttttttttttgaggtggggagcggggcgcgccaggttctcactctgtctcccaagctggagtgcagtggcacgacctcagctgactgcaacctctgcctcctgggttcagacgatcctcctccatcaacaccccaagtaactgagactacaggtgcgtgccaccatgcgcagctaatttttgtattttttgtagagacggggtttcaccacgttgcccagactggtctcgctgagctcaagccatccgcccacctcggccttccaaaatgttgggattacaggtgtaagcctctgtgcccagcctctactacttcattcttactgctaggagagacagcatgagactggggtactctgctttccaacatctaatatgatgagtaaaataaaaccagaaaaagagacttgaatacatgactgaatattcccaactgctgctggatttcctctgtgttcagaaatgttcaaaactatactgataacactaccagcctgtgtgaggcttggatctgactgccaaacaagtatttttcggccccaagactgtgagtaggaaaggagcatcagggtttgttaaagctgacatgtttgggactaatatattgcctccatctaacttggaacacctatagacccacagcccaaccatcaaaacacccaaaaagcaggctattaaaatataaacaaacacacaaataaactctgtaatcgacatgctcagactgaactgcagctgccccaaaccacttattttgaaaggcaggttgaaacacttggcaacaatctgacacacaattgtctgaaatcccttcgtatttaagagacagagcaaaagcacagccaatagcagcaggggaggggcgatccccaagggtttaggttagaaatcagtctacagaattttaaagctatgcacgtgctgtcaattctcaggccctgagaaacgcaactgggaatggaaaatactgataggttcctcactggagaggcgggagcttggagttttctagcatgctgggcaaagcacatctgcatgaatggtgaccacacacaacctttgcagtgtgctctcagcacctaggcaccaaccctgcctagggcttttattgttataaacatggataaaccgtggcagccatgtgtatcaaacaagggaacagggtggcagagtgtttccacagtgtcccacactcttgaaaatgaaacagatcttattggcttgggcaagattatctgttagaaactgaaggtaaacattagccatacacaagctacatatacataatgtctctccttagttcattatgatcggctgacactgtatttcaacatcctagtaatcagagactttaaaatagactttcattccagttaaagttttcaataaattttttttattgttatttataacctgtcccaggaaaaaataataagtataacatgaaaagccaactgagagtgaccctgtagcaccagcagtgaggcagcttaatatcactgggatttgcatcctatcaagctattcatgctgaggctgggaccctggtgctaatttctagtaaatttcacgcttgatgtctccctgttgtgggtcattgccggttcgtctaaataaactgcttccaaatggctcttccatctaaatattcagccagtttttataatttaattttgcattatgctgaatagccttccggccagatagagctcattgaaaaaaagcaccaataccatcttgacatgcttttatttatttatttatatctttactgctcgaattagacctcctaggccgactagtagagttttttttttttcccttcactaatgtcaattttcagcatagcaagagctgtctctaatcttttcctactcattacacacaattttggagtcattttacccacagtgcagtcggctcctggctgtgtgtttgtgtgcactgagggatggcataattgtttattttccctccctgcataatccccagccagtattgaaaccaaaactgcaaacatctccccaagggatgtgaagaatgacaagaggccctcagtttaggtccctttacatgagataatacaacaccctgacctgtatgtaaatatgaaaggcactgttcctccccctcctaccttcacagggatctctatcttccctaagtcttatttgtcttacgtgaggtgtaaaaggatgcatcagcaccaaaattaagacagaacttgccctggtctatatatcaggccaaaaactcatttcagaccaagggcagcagggagaaaggaatgggtacttattgtttaaggggtatagagtttatgttgaggatgatgaagttttgggtgtagataccagtgatagttacacaacactgtgaatgtatttagtgccactgaattgtacacttacaaataattaaagtgataaatattatgtatattttaccacaataaaaaatgaactcatttctgagctcttgaaatttcttttcacaataaccaaggacatccccaaagtagaggggaagtaggtggataataactttttcaggaaccttgacattctgttatagggatattctagtagatctagttctggttttaggctctaactgtgttacagggagctacatcacatcagccaactgtgttacaggaagtcagacagatccaccttcctttcccaactctgccattttgtagctgaatgagcttgggaaatttacttaacctaatttacataaatcttaatttatgtaaaatgttcataacaatataacctaccccttagaggtgcttgttgtgatgattatgtaagataatacatgtaaaattgttagcacaagtttctggtgaaaagagctcaatgaatcttaattgttgttgttcttactgttacagcgcggcagccaatctgggcctgagccaaaatatgtagcagaattgaagcttttcctagaagtggcacattggaaacttttgaactctgaactcccgttaggataaaatatccagggtgacactctgaagtaatgtcaggaagagtacattctcagtgggccccccacaaagagataagtaaggagtaatagcatagcattctctcccaggtctcaacaaaaatattagagccaaggaatttgggatcaagtgaaatctaatgctgaatgaacctcatatatatgaatgaggggttttcaggccccccttccctttgatatactactaccatcttcttttgaatatcctggtattttgtttatacattatggctttatcattttgctcaagacatttttcttgtctctgtgaagcaatgtattgtttctgacttattttgacttatttttgttctctgaagtggctagcatagttcctaacacacagaactcaataaaaatgtgtaggattgacttaaccgtatactctcaatttctcatggtatttccactaatttattatctcggtcaaaaaataattcaccttgataatctaaaaaatatatacaatcattaatttggatatatagtccaagtctcccccaagaaaagtataaaatgtggtagttctccagcaaatacaggcaaaggtaaacttttcaaccaaacacacacacacacacacacacacacacacacacacacacaatcaacctagtcaacattttgccaaggaggcctggccatacagggctcttcctagacgagtaaggaaaaattgtcggcaaaaatttcaaatccctcttgccacataactgaccatctggtagtttccccaggcatttcctccctcataggctgggggtgcttctgccctaagctatttttaagtgccctattgagagttcattgtttcacattttgtatgtcttaagtattttcttttctttttctttctttctttttttttttttttgagatggagtcttgctctgtcgcccaggctggagtgcagtggtgcaatctcggctcactgcaacctctgcctcctgggttcaagtgattctcctgcctcagcctcccaagtagctagggattataggcatgcaccaccccatctggctaattttgtattttttgtagagacagggtttcactatgttggacaggctggtctcaaactcctgacctcaggtgatccacccacctcggcctcccaaagtgctgggattacaggcgtgagccaccgcgcctggccatcctaagcattttctaatcactatttactccaaaagtttctactcctccctccttcccctaacctatcctactgttttttccttttttttgagacagagtcttacccttttgcccaggctaaagtgcagtggcacaatcttggctcactgcaatctctgcctcccaggttcaagtgattctcctgcctcagcctcccgggtagctgggactacaagcgcccaccaccacgccagctaagttttgtattttagcagagacaaggtttcaccatgttgaccaggatggtctcaaactcctggacctcaagtgatccacctgcctcagcctcccaaagtgctgggattacaggcgtgagccaccccgcctggccctatcctattgctttagaaccccaaattctccccaagacagatggaatttatacttagcatactctcataccctccaggtatgcagtctctggcttagcatggccatgaattatctggccatgggacagagggcttcactactgtaagaggtagtgtttcctttggctctccctgtagtgtccacagtcgctctacacatcaaggtttctccgtaaatggtgatactggctgcctaattacttagcaattcccatagcatggagtagagcctttgtaataatggtctaatatgctggagccacaggcccagggctgttgttagataataatataacatagcacaaattgccactggtactgaacagcctctggtactgaatttgttcattttcttccagtaaatgctaatttcagtatctgtcttggtcactgtagaacattaggagtaacaccaacaaagtatatgcccagaaaagagggacagagtcacaatcatatttccccagcaccatcagaatggtccagcatccatctgtgagagcgagatccacaacagtaggtcacctcaataacactagtagtagattattctgaaattctgtatggaattataaaatgtacttttttccattcaagttgcaactcaaaagatgtctcagagagggcagaatccccaaaaagcctaggctattaggacacccacagattctgctgaatctataccctccctctgccgcagagtgcccagtaatcagtgatgcccctccagcccacaggcagcccagtcacctttcattccaccagagaagcctctccagttggcaaagaccatcagaggcagcccttcccggttgaagtccttgatggcctgatatgtcttaaacgcagaatctgggaaccaaacctggccagcctgctggattatctattaggaaaagtcaaagaagacacaattaacaacacagctccagggggaaatctctccaaggtgaacaagattttacttatttaaaactgaaaactaaaaatcagatcaacaaaaactattgttcatcaagatcatcatgtttggagtaaaaaagaagaaaggatcctcgatctttgaccttgtcaaatactattctttttaagtcctgattataataactctgtagtcaaaagggaagaatgcagtcctaagaacccttgttctaggtttctcaaaagctacttaaaatggctccattgtgctactctttaaagcaagtcaattgtacatagtctcccagtcctttcacctttgtgcttagtatagcattttcctgtactgtggctaacaaatagacaattgacgtcacactgctgaatagcctcctccctggcctccctgacccctcactttctgaatggtgtcaggatgtgaaaatataatccatcctttaaaaaaataatggcaccaggcacagtggctcatcccaacactttgggaggctgaggcgggaggatcccttgagcccaggaggtcaaggctgcagtgagtcaaaatcacaccactgcactccagcctgggccatgaaccatgtctcaaaaaaaagggctgtggtgttcacgcttggcattagggcagacttcaccgttaactctagctgtagctcttccatgtgtatactcagagaataggggaccaaagagccttcagtattatctcagctacctttctgtaagaccatctccccaacaaaagtatacgttttctagcatcaagaagactactgtaaagacttatttaatttttgaggcagaatttagcttctagtccgtttagactcaccttaaaagtgagcacatgatgttctaaaatcattcaaggctgctgatgcccttccctctaaaactgatggtttgcaatgttcctgatgtattcacaggcactgcgaagagaaaaaccctccaagcacagcccccagtgtacttgaggtggcctaccttggcttcagaatccaggtttgctggatcagctgggatacttagttctactgttcgggtttctacagcaacaactcccacaggtattcctcctagcctgataaaacatgagtcacataagaacccaatgtatgtcaacattatagctagccatttgttttccaatcccaaatcaagacattggggaaaaaactagaaacaaacacagagagcaggggaaatctgattcttctatgagttaaatgtgagactctacggatttgatatttactctctaaatatggtgggaaaccaccctcagaatcacttctattcggaaatgtcccaacacaagataaattcaaaccaagggctgttctaggggagcctctacatttagactcaacagcctagcacatatacacatccctacccctgtggctgctaaacgaaatttctcagttcactctagagcatctccttggtgaagatggtaggaaatggtctgaaaggcagtaggaatctgagactttcagtaacttttaatgaggactgaccttgctgaaatggagctgtagttttctatggaatattaataatgtggttccagataagatttgagggtacaataggtcttactattaggtgtgtggatagggagtatgtaggcatgttatgaggatgatgagaaacacatgccaagaatagggaagtggatcaacaagcccttaattttctccttccttggaaaagacaaatgggacaaggataatttttagtagtaatgctggtgaagtctatattagaattatatatttaatctcaaagctatgtttatttaaaaaactgtttaggagctcaaagcctctgcaccttatactccactatgacttcccaatttggtcctcataaagattttctaggaaaaatcagagagcaagacaaagtacagggtgagtctttactctggaaaatgtgatgcagtcttcattctcactgttgcattccttggggttggggctgggatgggttatagtctctcatttctcacagcatctccataacaaacttttccatgacagatggcctttggttgttaaattggctagtgaaaatggattcctgtcatcacaagagggctgacaagggcctgagtggagaccacccacccccttgtcacttgcctgcactgaatcagaatcaaaagccctctagacaaccagacaacgagcaggagatacacaggagggtttagaaatatttctgttcacaatgattaacaatccaactggaaacttgtaattgcaaaagccaccctaaatcggtaacttataacttatatattagggcccatgtgacctaataaagaacatctttatccaagtattacagttatttattgaacttgaaaacagctcagaacaacttctgttttctattatacttcatataaattttatcaggctagcacatgaagatgctacatcttgttttatagtgtgtccctggacaaggtgccatggaataataaaagacaatttacagccaatagcacacatattccaaacatacataccaaagatgagttttggcagcacttacagtaacaatcccagacgaatacatttatatttatttcttgaaatgccattgcttttgaaagaagctagagctccatttgtgttttatatacttgtgagtatgtgtatacgtttggagtaagaagcccagaactcgtcagatagaaagaaaggaggaagtcagagtgagtgttgcaataaacaatgacagagctaaccaaagccaagcttgactgatcttggtcgcaaagcaatccctattcttctaatcataagtgtaaagtatttttctcttatttcccatgggaggatcttaaagaacttaacaaaggtttggctttctgagacttaaaatctgtcatgttttttcacagacaggaaaattgaagcagaatagatgagacaaatctcaaaaaagttggtcttagtgtgccgtgaggaatctaacaagctgatacaggagtcgagtatcagggttctcgctccagtgtatctcctacttccaagctccccactgggaattttaccaggcacagagaatacttctcactgggactgagaagcctggggtgagataaaagacctgagactttaaagaaaacagacaggtaggctctgggacattcagtctgagctgactccaggccagaatcctattcagagtcacagaggaagaccctgtctgtgggatttgccctctgatggcttcttgtcacaggcagcatggaggcgtgctgacctgctgtactgagagaaccacagagcctagaattattttcaaggctagaatctaaatctcaacccaatgtggcatgtttgagaatcttgagcaggtgccacttttcaccaagataaggaaaactgattgcccccagaggaaggtgagctccagatgcggtccctcagcagcatgtctctgcagtgcagaagtagattaagatcagtcgtggcaggtgctcgttatagctcgttatagcaagcactacagattattttgcacagagcttgctgttgagtgaagcacttcttagagtaggtattaaaatttaatagaaacttcaatttcccacttcaaaaatataggtatcttggcaacctatttcagcttattttactcctgtttcaggtaaacttttttttttggcaattcacatctgattataatccaatatagtacatttgtcacttaaataatctcggtgccacgaagaacctctttccagttacatagaaaagcagatgagtctctgaatcacttgtcacctattcctgaaagaaaattgtctttgggagagggaaagtcattggtgggctctggctattgtagttgggctttacagctcccaaagtgtttttcctgaaacattataaaaaggaagtgttgtcaaaattagccttcagattaaacgcatcattggagtgacacacaaaatggcaactgagaaccagcactccaattattttgccttgggcatggctataatccaatattctcagacagttcagacaaagagaacattattggtatatatctatagagccatggctctttctttcttatttttagttgggaggaaaaagagctgccaaaacaaaagagctcttacctggctctaccaaccaccacagtctgtgcccagggctgcataatctctgagaaagatccatagtcaaaaaagccactcaaccactgacctttttgggctacagaagggaaagaaagaaaacagagaataaggacagtgaatccattgacaatgtgctggaactgacgaatttaaggtggtttgggggattattttggggagtttgttgtttttaaccaaattataatagatggaagcattaggcagctgaatgttcatctgccttcagacatcatctcctatttcatttgctagtctgcataaaaagaatcatttatcagcaaaagcatcatttattgttaaatgacaaggtttagctagcagagagagtttgcatgcttttaaataaataacttgactttcttcaagacactacaaacatttgtcaaaaggctgccaagtcattaaagatattttcaaaatgtctatttctattttaaaacttgccttacaattttgtttgattccactgactttcttttaactgaaggctaaaaacaaccaaacaataagtattaatgatcagataaggatccaaatttggagggaaaaataggaactcagtttctccgctacaaaagcaacaagatatatctactttattaaacagctgataaagtataacctttctacaaaaaagggccacatattcttgacagatagtaaaaatacaatggttaagatgcacatacttaatgccattaatcttccttgcacatagaatttccttcactggcaagacccaaaattttcaacatgttagtttaaaaaaaaaacttttgttccacaggtataaatgtttgaccaaagccccataaaagcttctgcaaataaccgtttcctagtttgccctctcagctcacggttttcagtgattcttctaatttgaacatggccctccaccccctaaaaacccaagtccaaaaccaattaaaagtggagatctgagcaagctaacctctgctgacttaaacaggatggagagtgttttatctagactaaacttgtaattactgtgttctacattccttgcctctatggccccagtgtaaaatgtgatcatccatttcaaaattatctctccatccgtgagcccaaagccgatcgtttagattctggtcttgtgttgggcgtcagtttgaagaatatcacagcactatctcctctaataaatgactttaacttttcacctagaagatatctgctttaacttatcacagggaatcatctgctttctttaacgcttccactaaattaaaatctgaagtcactcgatttgggagcgagtgttagctgcacatagacagcaggatgaattactagggagtcaatgaaaaaatattatccaaaaaacagaaaacttagtttatcaaaaatttcattttattctgtggatttcattaataatggccaggataatgcccacctacacacacatacttctgttcacccatgaaagaaggactcaaattttggtgaagtttctaaaccaaatttctaggttcatcagaacactgaattttaactttatatctttggatcattttctaattcttacttcaataacagggatttggaactacagaattaacttcaagatggaaatgttttcttctttaaaaactctcctgctaggggtaggaggagtcactgactattgtagttgtgcttcacagtccccagagagtagatcctacccagttccgatgcagaaccttagaagccggctaagatggcttcccgtatttcccaggaaaaaactcactaagtcttgttccaaattctagaagtaaagaggctcacttcattcccagaaaagtcctgcattttaagactgacaggtggccgggcgcggtggctcacgcctataatcccagcactttgagatcacaaggtcaagagataaagaccatcctggccaacatggtgaaaccccgtctctactaaaattacaaaaattagctgggtgtggtggcatgcacctttagtcccagctgcttaggaggctgaagcaggagaaccacttgaacctgggaggcggaggttgcagtgagccgagatcgcgccactgcactccagcctggcgacagagtgagactccgcctcaaaaaaaaaaaaaagaaaaagaaaaaaaaaaagactgacaggtaatcttaggctcatagttcttatcataatcatggcacaaaaaaaaggggaaagaaggggtaagtggaggcggaggttgcagtgagccgagatcatgccattgtactccagcctggaggacaagagtgaaactccatctaaaaaaaaaaaaaaaaaaaaaaaaaaaaaaaaaaaacagtaggaagaagattagtatggtgactttccaggcatgtaaagaaaaactatttcgttttattaaaattaacaagaagaggcactgaagacaacaggtaaagttataaattaaaataaacacttctctcatgtttttatataatagaaagtctaatgtaaatattgtagaaaaacaatgtaatagctatataatagctatgtgaccttgtacgaatcactcaacttctctgatttttgtaaaatagttatctctctttatctaagagaggtcgtaagtgcaaaaaagatgtggaagtgctttacagtcccacctggcttacagtgggtacccacaaaagtttattaggtcttccttatgaagacctctctttcagcaagatcacaatgacttttacacttaataaaataccttctgcaatctcttctacttttatatatagcctttctttgaaatagttgcaataaatatgcaaaaaagaacaaatgcttcctcacatagtttgaaaaaatggattcaaaatacagcagagggatttggtgctccacaaaagaacctcctgataagtaaggtttgctagaacagccaaatggactgacaaatgagaatgtacacagagttacttctttttcctgttttgtttctaagttaggtaaaagacaaagcagtagattagatatatctggagggagagcttattctcactccatgtatctatataattaaaagttctggacaatctcttcatgaataaatgaacttacaaagtagccttctattacttactaaagcaagtaccaataccattaccaatatcataagaagggcacatgcagcgtgggtgctcagagcttgctgagaagagtgaagtcatattctacactgaagggtctcaaagacgtgtgctaaaacgaaactgattaatctcttttggttgtagggattagatgactgaagattctagtcctataattttatgattttatggcttatattgaactgtgttaaagtctttgaacccattaagtaataagtgctttaataacagaataaacagaagaaatgtattcgtgactgcactgcttgacttaatgggtgattgggaaatgtcattttatttatttttcattttttcatgaaggatttcccacctttttcttcagagggctggttttcaggtctttctcatttctaggtacttacctctgttttcttagtcacatgtgattgttcaggaattggatagtgattgaaaagaacgctaaaagcttaagagccaggtaccatggggtcctcaaacatatacatacttgggtgaggacggcctgctagcatccatcgaggatcgtatggggtctttgtgggaacaaactcgatgattctgtctataggatcctttgagttcagaagaggaactgaactgtgcacgctctaaaaggagattggaagagagcacagcaatcagtgaacgacagccctagactccaactcagcaacaatagttacagacaaagacagcagggcccacgtatggaattgcacccaatagtcccaatcttcagctggaagaatcctacgtatgtgccaggccccaaggaacatgtataggtcaatagtctcatttaggaggctggcacaaagtggtgtgttttgactcttgatttcagtgtgcccatgctttctgggatgctcctctgaggaatgaatggctattacagaggagaaaacccacaatgaggaggaaccttaatatactgggatctgagccttaggtaggccatgagggcttccgtggctggaagacattagaaaggggcccaacaaatgaaatccagagacatcttaaaggtagaaggcaaaatatggctgtaaggaaaagagaaatcaatagctttcagagaaatattttataaaaaaattcctccaccataaagacaagaccttaaacacagaggcagtgagctgtggtggaaatgacaggctctgcaggccatgtcagtgctgggtaggaagggctcaccttgggcatgtaagacagccagtgcaggacagtgaaaaccccttcaaagtcatcacacacagtgcagtgggtcaccccattgttgtgcataatctggatgccccccagctggttattggaggtgtacacttcccgcccgaggacctagagaaaagagcaagagaaaagacatttgtctctatagaaataaaggcatggtcgatttcacaagtcgcactaaaatgggttcttttctccacaaaacagagatttcagtctccatgggttggttgttctgagggactatctgaatcttcttcctaaaaagaaaacttagaaaacaaaaaatatgagattgacgcgctgccagctgcgctaagagggcttactatagcattaggagatatacctaatgctaaatgacgagttaatgggtgcagcacaccaacgcggcacatgtatacatatgtaacaaacctgcacgttgtgcacatgtaccctaaaacttgaagtataataaaaataaaataaaaaattaaaaaaaaacaaaaaatacttttaacaatcacattcatggttgcaattttaaaaccagcaagcccctttctctccaccagctgccacagataggcaaagcatacttccaccctcagctgaaactgcagtggtgggtgaggctgagacccagaggcataggctacctcattgtgtgcaagtctctttgcacacagacacaaaaaggtaacatgcctgtctttcaacaatatttagtgacaagtctcagttaaagaaactctgggggcttaggttcctcatttttaaaaaggattatttttttccttatatttgatttttattagattggtgcaaaagtaattgtggtttttgtcatttaatggcaaaaccacaattacttttgcaccagcctaacactggcctccacgcacaagccctaaagctagcaaaaacctgaagcaactcatgatacatacatgaacccctgagtctcaagtcttctttgtgtgctgggtgcagggctgtgatttatacccaagcatgcttcccctcctccttcccttcccaggctccagggagttcagggcctcaatccctggtatatccctggaggaatttaatccttgtaaggtcaaagggcacctgcaattggaaaccacaaagtttcctttaaagaagaaaaaaagaggaagaaaagatattcctggacttggaaattgcagggtttctttttcccttgaagactggttaataatttctttcagggaaggaggttttctgacccagcagatggaagccgggcagcctgatcactgactattgcaaactgctgagtgtatagtaattgtcagtcatctaaggtagccccggagagctctaaacagttgtagagcgcttactgtattttaccttttctttttcctttcccctcctcctttaaaaaataacgacaatacaaaatttcttccgtacgtgtattcattttcagtctctggggagaatctaactaactaagggccagcaaagtctgcctgtatattcccattttgccccttcttgttaggagctttgagaggttcccctgcatgctgggtcagcacccccatcgggaccttccaaagatggaggaagttggtgaccaaagtaataacctcagtgtgacccaattggccttgattccatttaacttcagctaggaagggcataagatacttttctgaaaggaatatggaaagcaaaattgctctcagattactgttttccttgataaggaagcgcagagaacaagcctttacaggcagccccaagctgagcaacatgctggcagctcctttgaaggagcctcgtgaagagggaagacggtatctgaccactgagctcccatccgcctctcagtccgtctttaatctcagcccaggcactgcggctcttttctcattctcctgctgtctctttccatttgccctctctctgactgatacactgatctctcggtcactcagctttctgctctgctgagtccatattactaataacacctccgccacggccagtttacctcatgaaggcaggagcacatcattacaaaataaactcataactttgacattctagcaaatacacgccgtttgttatttttatggctttagtctttctaacaggcagagggcattacatacctgtttcatttatatctttaaatgtgcacacacatgcacactcacacatgcatcaggaaacaaaacagaacaaaaaatccaaaccaaagcaaatatccaaagcagtctgttgatgcgggagcctggtagaggcagaaaccctgtcacttacagaggccacgctctgatctggctctggttttatggtcgtcataaacccgatggcccacaactggtccttctgggacagactgcctctctgttagaaggcattcagtgtgatcagcagtatttttaattattaaaataaaattggaaagggggaaaaggaatacaaaaggagacactgtgctgaccctgaaaatctgatattcacaatctaggtcaggagccaagtactccttgttgcccagaagagagagctgggccattttctactcagaaacactattttcttcctatctctaatacctgataatgtccaaccacttagaatcttacacatctccaaaactaataatggaccaataaagaactacactcagaaaaagggaccgctcagctgtttaaacatactttcttctgatgtctttgcctcctcatttaaaagtgatcctctgccacttatctattctaccccatatttttacaaaataatgggaggcaaacttggtaggctcaataactgagtactcttctctttacaagctaaaactcgggttctgatgctttggcattgttctgaaaaggcagcagtatttctacatctctcctttcctatgtttagaagaaacctaaccagggcttaacataccaagaacattatttctgagctaaagaagtgtttgtcatgtgagaaaattcacttaattcagaaattaaggagaaaaattacagaatagactaagagtatcccaatatcactctctgaccagccttatcttgggagatggggggtagggtggggatgggcacagaaatgaaactgctccactaatcacaaacaaatgctaacaatcataactacttaacaatcggtgaagagaaagcagtaccctccagttcatcttcaatgaccacatgtttggagtatgcgccagtagaatgagggcgcacacaatagctcctgatttataggggtcgttgctgactcaagtggttttaatgattttagaatacttcacaacaaaagctccaaccaaggaagcagaatctgggttaggataaaatccattctgcctaactgtgaaatgatcatgctataacagttacacaaaccctcatcagtatctaggaagacgaatggagtccacatagacagaaccattgttttcttcctcaaggttgccctgctgaccttctacagaaaaacctggggtcaacaactctcatcaacatattttcatgaagtaggtgagctgcattcaacactcttttaaactttgacctacgcatttcttgccgtgtttcagttcccaaatatattcctcttacattctacttactgtatgatacaaacttttaatttatctgtccagcaagcatcaataatcatttaaacacaggagtgagtcaaacagaggtgattctcctgaggcctcactttcttgccctccagatctaagtggagaagcagtaccatgcaatattaggaatgggctccaccttggggtcctctgctgaagagtgccatgctgacagaattgaataagggctgaatctgagaggaaagaggatcttgactcattctcaatataaacttaagcctcatccagtacttcattcattgcagccggcggacctaagaattaagggcaccacataaaagccggtgattagcagagacacaattgttaaaggctccaccaaagatgctacgtagcctttagaaatgttgagatacataagaagtacaaatgaatgcagtcatacgtccatgctcaggcctctgctgctgctgctgcttatctagagacactgcagacagctcaggtttaccacagctgacaggcaatgaaaacagcctaatataccgcctgctctctcccttaaagccctttttggagatcaagataaacacgtacttcctttcccccatgctccagacgtttgactgaagtggcagagcattgtgatgttttgtgcaaatgaaatcactatgtaatactgaatgagtgcagtatttacttgtcaggatatttgtcagcacaggcattgagatttccaagtttcacagatgcaacttagctcaattttttaaaaattgcctttgtcctgacatacacattatgttggggacccttagacttataggcaaatatttgcaatcatgtgctgaagatgtgaaaaattatcatgcatatcaatgatggaataaaaaatgaaatctattccttctcctcctctttattcagtcttttccccctctttaaacaatgctcggtgggtcaggacatctatttaaggaagcagggaatacaaaattcctcctgcatctaagaattaggctacacaagctgagtcctcgctgcaatcctccttcttattaggacatttccattctcaagaggatttgaggaggggttttgtaaatttactgagtaattgtcatcactggacttcatccatgattctagatattaaagtcactctgggatctgtcaggttattgataaaggttggctaaagctgaaagagaacagatatgagaaagaataagcaggagtagaggaaaagtggtaaaatagggacaaaagaaagaaggaaggatgagagagaggaaaagggagggggagagaaaggaggaaggagaagaaaaaaatgcaatagctcatctactcagtgcagctaatatcctcctccctgacctgagaggactacattttaaaaatctgacaagtaattcaatctccaattaacaattttaagtggtgctgcacatatcactgtgtcaatgtttcttcaggaatatatccaagggtgaatggaattaaatctctagggagatggaaccaggacctatgtgaccaacaagattatttgggggttccaaaatacagtttcttaatgcataggcaaagggttataattttttccccactttattgccactactgtcactggcaaactggagtgctggctggcaggtgctaggctagggttggggtagagaaggggctcggtgacatactgtgggcagaagagagaaaagcctctgacatgagccacagctggattcaagaccatttgctataagaccaaaaatctctctataagcagcaaatcatgaagtgatcaggtatgctgaaggataaactggggcaaaggggtggtactgtcagtggaaggaaaagaaacagccaaaaagaggctgaatataggccagaaataacactggaagacatctctttactgaggtacagggctcagtggagaacagaggaatgaattagacagcagaaagacaataaggatttgaaggtggagtgggtaaggaacagagactcatttgtaatgtaaaagatagagaggagccacacaatagtttgctaaatgtatgagaagaagcacaggcttctggaaagaaagctgccaaaagtaatcactcaccctagggggacccaccaactgctcatgtaggtagggacttgagatttctgataagttaattccaaacaggaattcttttttttttttttttgtagagacaaggtcttgcacgttgtctaggctggtatcgaagacctggcctcaagcaatcctctcgcctcagtttcccaaagtgctgggattacagacatgagccaccatgcccagccaatttttaaaaattttaaataaagtctggtttattgaagtataatttacatacagcaaaactgtccatcataaggtatacaagtctgtgaattttaatacacatagtcatataaccaccacaacaatcaagatagagagcattttcatcatcccaaagtctcctcatgttcccttccctccctccacccctaacaaccattgatctttttgttccagtagttttgccttttctagaatgttacataaatggagtcatacagtacatagccttttgaatctagcttctttcagttagcatattgcatctaagcctcattcatgctgatgcaggtatcagtagtttatttttattcctgagtaatattccattttatggaagtaccacaacttggtaacccgtttgcctgttggtgtacatttgggttgttttcacttttggaggattataaataacactgctatagacatttgtgtacaggttttaagaaaagcccaacctttttcaaagtggctgtgccattttgcattcccaccaacaatctatgagagttccagctgtcctgcatcctcatcaacacttggtatttgtcaaacattaaaaaaaaaccatttaggccaggcacagtggctcacacctgtaatcccagcactttgggaggcctaggcaggcagatcatgaggtaaggagattgagaccatcctggataacacggtgaaacctcatctctactaaaaatataaaaattagccggggcgtggtggcacatgcctgtagtccctagctacttgggaggctgaggcaggagaatcgcttgaacccgggaggtggaggttgcagtgagccaagattgcaccactgtactccagcctgagcgacagagcgagactccgtctcaaaaaaaaaaaaagcaaaaaacaaaaaacaaaacaaaaaacaccatttagtggtgtcaagctgtggtttaatcttcatttccctaatgactaatgataagcatcttttcatgtgcttatttaccatccttatattttctttggtgtaatgtctgttcaaatttcttgcccatgtttttaattactgggttgttttcttactgagtttgagaattcttttggataccaatcttttatcagattatgtattttctaaagatggaaaacttttaaaaaaatccctgtttgtcagtcgcctcctactggttttactgaataggctgtgactgactgcattgctcaccagtgtccaggccccaagagtatggtgtttgcagggcctcgctcttaggggagtagcactgacttactatctctgtggccttttggtttgtgttttctcattgacgtctgatgggcagcaattttattttttcctttagaacacatgaaaggcctattattgtcttttagctaaatttcagctccatgaaagcaggaatcatctttgtattgccacagcataagaacagctttatacctaacaggcatgcaataaatgcatgtgatctaccacatttctatgtattctataaaacctcaactgattagtatgttcagcaagttaaaccactataagcaaaataagtctttcatattagtgttataatgtgtagtggctttctgaagcaaaaggagtggttcaattttcctacctttttagttttccccaatgtagatgcccctctccctccctccctgtcaaaattctttacatgggctaaaattaaactagtaattctaagtactataaagtcatattatgttaggaatgctcttctgagctgcataaacctgctttatctattgagaaaggcatattttaccaatgggtcaggtagaaaatgaagttactcaaaagttgattacatgttccaatggtcttgacttctcatatttgcatcttatgctgttggttaaatttgggtgggttcttttccttaccaacactgatttctcaatttcttagacgcgcatactattttagaaggcttaaatcccagacactgagacattattaaaattaggaaccggtcaaaaatcagccagaaaatcttgaagcccaggcatggtaatctgtagttcaatctaaaaagctctttaagcttctcctttcataattcaatattcctgactgtgtacattagctgattagactgtgtgatgatggccaatctgaatgagaagggacatagctagatttggatccatgcacagggaacattccctagaatgatgaacagctaggagtcaggtttctaaacagtctcatttccgcttctttatcatattcatagaccagtctgtgcacagccagggcccagctctgtcttccttctagaaaagactggagtccttgcatttctaatctactaacgtgtggttcttgcacttttaatttatgagtgttaagggggacctttctgacttgggaacatattggctcggtctaatgcttggagattattaaacttggagctatgctccactatcaagtctacagatcttttatttagaagatatggtgctctaaatgcacaaagagctccctgtcaccttcacattaaagcccctagtgcctggtaaatggaattatatagctgtcatctcctttccccaaagttgtaagagtacaatgggctcattttttcacactccatcccagcttcagaactaagagacctactttgtattgatttaaggtctcagaaataaataaacctgcttcaccactgtgattcacaacaaattcatgatacactattgcatgatatatttcaagctcttgctctggctctctttttcttctggtgagtaatgggggaggtgggaggtggtagggagctgcaaagctgacagcctgatggttattggagatggttgctgactgcaaatccaagaatagacactgttggaggagtacgggaatttttttacaactagggggcaggggtgataagctaatttacttgggcttcaggctggggttgggggagaagaaaggctgaagagaggagaggggttgacagagtagcaaagcttcaagtgagcactgatctgcaaagacagagctatgaatatatgtagaaagagagacaggtgaagaaaattcaacatatgaaggtgtaacacacaactgaatataaaatgaagaagacgaagaaaccaatcttcctaaggaaccgtgtgtacagagctaagtgggcccttagcttgagttcagagacaatgttttattagaaacagacagtgtagagaccctacatgccacccaaagtgtgaggtagaggcatttcttcattctaatactcaggacacatcagaaccctggaggtggaaatggacaatggatatagggtagagatataatgaaggtccacatggatgaagtgagccagagactgttcactgaggcaagagggtaatacattctagcagtttagcttgtgtttgtgtacccttggggtttgagtacctaagtctacatcacctttactgattccaccaaatcttaggcccaatgagttttagctggtatctacaaatatagcagtcaaaaagaaatatcctccaaccttatttcaggatctggactttcaacaaggcagaggaggagaaagcaggagataatcgggctccgaaggtactgcatggcactgcaggagacccctaaggttccaaggagtacttccaagtggaattaagttttaactgtttctcttgtttcttctacttatttcacatttttaactggcaaagttatttatgaatccaatttcttttctatcttggaatagcattttcatcttcactacatttgttcttgagacaagaccagactctgaacacaaaagtacatgagaaagattttggttccattcaatttccaattggtcatatcacaaaactgggagtttctttgttaaatttgaacactgtctttaaagagtgatcagtctctgtacagggaaacagactttagccaaatataaaaaagaattcacagatgaatacatagatgaatgggattggctccaaaagtactcagctcccattcagttgaatttttcacacataattgggtgaatatttagcaatggtgtcacagaggagattcacacaacaattgtgtggttgaacttttgaggatcctcccactctcaagatttataattctacagccacttgtgattgtgaacaacatatagtgtttacttttctgtaatctggataagaaacaaaattaaaaaaaattttaaatcatcatgctcttcaacttccattcctggtctcacgagtatgtaataattttatatatcactaatatgtaattttatatataataccctaatacgcaataactttaaaaattccccacctcctatctattcactccccagcctaaaacagttccctggctacagatcaatatgcatctttatagcatcacagaatactagatattgaacagaatttaagattaagagatcctctggtcttctacttaaaaaaaacaagcaaaccaaaaacaggcttaattcactttatttttcttatgtaaaaactctgtgttgtagccacagttggagcctgggtcccctgcatggagactctggtgtgggtcttgatgaggtggtcagtgaattcctgacaggaagacttgatgaatacagtctccttccagaggtcgggggtcaggtagctgtaggttttagagatggcatcaaagatggccttgagaaagttccctagggtggcagtgcagcccctggctgaggtgtagcagtcatcaatactggccatcatcagcagcttcttgggcaccagggccgagatgatgccagtgccccgggtgcagggatgaggcgcaccagcacagagccacagccacctgtcaccttgcaaggaatggtgtgggccttcttctcccagtagcctctgtgcatggggacaatgaagagcttggccaggatgatggccccatggatggcagtggccacctccctgaagtacttaacacccagaccaacatggccattgtagtccctgatggcaacaaacatcttgaacctgatgtgctggcaagcacgcgtctgcttctgcactggcataatcttcaaaacctcatccttgagagaggtccccacgaaaaagttagtgatctcagattccttgatgggcagggagaagagatagatctcctccagggacttgatcttcatgtccttgaccaggtggcccaacttggtcatccattccttgccctcagccttgcctccatgagctctgtggggcccaggccctgttcacggccatggtcccagccctggatgccactgccaaaggttccacggttccccatctcaggcacccccacacctggctaattttttaattattttgtagagggggtcttgcttcttgctatattggccagcctggtcttgaactcctggcctcaagccatcctccttccttggcctcccaaagtgcttggattataggattaccacgccaacctgattttctactttaaaatgggaaatgtattatgccttccatttcacaaagaggaaactaacatctaaatagattaaagcccaaagttgcttacctagtaaatgtcagggagaagaacaatcaaaagttttttgtttttttttttctgagatggagttttgctgtttttgcccaggctggagtgcaatggtgcaatcttggctcgctgccacctctgcctcccaggttcaagtgattctcctgcctcagcctcctgagtagctgggattacaggtgtgtgccaccacgcctggctaattttgtatttttagtagagacagggctttaccatgttggccaggctggtctcaaaccactgacctcaggtgatccgcctgcctctgcctcccaaagtgctgggattacaggcatgagccaccatgcctggccaagttttttttgttttttttgtttttttttttttaatctaaaggttctgtaactccaaaaaatttgagcacattcataataggttgtcaaacatgataatttccgagtctgtattcaatgccccaaatagagtctcagagctttcactttatctagaagctctggactggtacttgctgtagggtctcccaaattcttagactctaagccaccatatatgcatgggctctcttagagtcagagacaacttctgcagtggagctctgtgtggcgattccaccctgcaagatctccaaaccagagcactcaggattgttggcaggtcactaaggcagactaatagagtcaaaacataacctggtatagttttctaccaaacttgaggaatattgaatgaaaaacaaacaaaataatccccccaaatggggccagatttaccaatattttatgtgtggggagggagcgcttgaaaattagggagatctgtccattgtgcaataatttctgagaattcattcataatgctaaagcaaggattactcagaaaggaagctaaaatgccctctttagaaaggagagtgatcccatctggagctatgggagtacagggactgtctattgtgaaaataggtagttagggacttttaaaaatgcaaattgctagactgatccttagagtgattatgagctattgtatcaacgagtccttggggactcttgtagacagatgactgacatatatactaccctgtcacgactgaacatcgtgcctctcacattaatggctttccaaagtgcgttgattgttgctagatacatctattgggaaagtcaatacatgaatgtactgccacagtgaggactgtcatctaacattttctggaagaaatttttgccttcaaagaatcagaaagtatagagaataatgtgttcgtatttcctttccagaaccaggataagaaattgcaatgagaaggaaccctaaatgaaccttagagaagactatggcagtgccaatgttttacctattttggctcatttaattctcacagcgactctggtacacagatactattattactcatcttttacagttaataaaactgtagcccagagaggttaaataaattgcccgaggtcacacaactaagtaggtggtagagccaagaattaaacctgggcagcctggctctagcctctccatgctcataacatcttttttttttttttaactaataaaaaaattgtaatttacttagaagcattcagaatgccaacaaaacagctgcaactttttttttttttttgcaattacagagtggtattcagttaacagaacaattgtttcatataagctgcatcagagacaattgaaaatgaaaaaactaccaaccccatatataacttacatgtgctgtgcaccaataagaacctgcttaaaatttttatgccaatttacaacccccatcctgtaccaggcaaggttagtggctatgaaaataccaccaggacagggctatctaaagacacttttggtagtgtgttaactatacaaaagaagacaccatacagtttaaaaaaattcttacacagccttacatttcaatttttttctttaaaaggagtgagttgtatacaggggggttaaatgctttatagacaagaaaaaaatctgtgctagaaccaacttattcatcatcatcatcttcttcatcttcctcctcctcatcctcttcatcttcctcatcttccttgtttttcttgctttttcggccttggcaactcccttttttgctgcatcaggctttcctttagctcaatatgcagcagtatccttttcgtatttttccttcagcttcgcagccttcttttcataaggctgcttgtcatctgcagcagtgttattccacatctctcccagtttctttgcaacatcaccaatggacaagccaggatgttctcctttgatttttgggcgatactcagaatacaacaggaagaacgctgaaggaagcctcttgggtgcattgggatccctgaacttcttttttgtctccccttcaggagggacgtaggttttcatttctctttcataatgggtcttgtctgtctttgccatatcttcaaattttcccttctgtttagcagacatggtcttccacctctctgagcacttcttagaaaactgagaagttgactgaagcatctggatgcttcttatgctcctcccaacaagtttgcacaaaaaatgcgtatgacaacatcttgcctctaggcttcttaggatctcctttgcccatgtttagttgtttttccacagcgaggcacagagtcacccagtgcctgtctggctctcgcttgccccggcgctgtctctatcgtaacctctttaagttatgtgaaagttacaatgctgcccgccccacagtgagagctaagtaatctctccttcccttcttgagcctccatgactttcatgctgtgtttcacagagtcatgggtgggtgagcatggagactacacagtgcaggtccctggtgtaacagacaattcccactcctgagaggaactctggtactgtgcctaacagagtcagctatgacaacttcacatttcatactgcatagctgcagaaaaatacatatatgagaaccagagagaaatgtaacttacttgcaccaagtctcaaaagcaagattagcagaattagccccctaccaaactaatggccctagtcatacccatcacataacttcttttttcctggcagattcagtggaaataggggcctgatctcgctaagggggatgagagtataggatttttttttttctaaaaaagaagcagagctttaaaatacaagaaaagtcacatatcatctcccggtgaatctatcacctgcatatcactgcctttggcatataccttaccttcacagtcagttaatgtccacaggacaaccataaactgcatattcttatttctctggatagagaatgtgctctctctccccaagtctggggcaatggattgagagctagtaggctccagtacacatcagtgttcctttacaatactagctcttcccagcctatctgccacctaacactatgttaaacatactaatacttttaccaggaaagggagaaaaaaataaagtaaaaaggaaactgagaggaagagtggtgggaggagggaagtaaatatgatcatctctgcaaatgtccagtggcaaatagacttaagagtttatgactctgcaatcatctcagctccttaagggtgcatcttaacagttccccaagtacacaggttactgcctttgccaggccagcatgactcccttcaagcagggtaatttgccacacacatcaggtctgccacgcagtgaggcattttaaggaatctgtcacccacagcctacagttcctagagttaggatctactaccttgagtgacatgaaatagcaagcccctagaaacttctcttattaatgtcatcattctcacgacatttggacaaacaggaaaacgaccggaccaccttctcttaggctttacagaccactaagcaaagaggcctgagctttcttcagtgaaacttagggacatgaaagttcatgttctgaccctgatctagtctctctcaatgaaactaagtcactttcccttctgtttttgccttcctgtctacgaaatatagccctgataccattagcccattccagaagatagcaaggaaccagacagatattcttgactgaatttcaagcaaacccacttgggctgcttctaatcaccagcctactgcctttagttctaatgtcaaatgtgcttagtaacactcaataaaatccagatactacaactcatctcaatttgggtaatattttgaatattttacaaataactgcaggcaacaaagcaagacagacatggaaagaagatacacaaatggtgagttcacagggggaaaaggataaaaatacgaaggtgggaagcacttcctggttttggaataaaagacacagtgacaaaggatggcgtccatgaataaaacatgtaagtatacagaaaaaccaccaaaagtaaaaaaacaggaaaacaccagaaaatatttattttatatgaaggttactactgttggctataaaaagaaatcctttaaaaagtaagagtctttggaagcaaaagataggaaggtgtaaactaattaaaaacaggctaatgacaggcaacatcatgtgtatgccaagatggagtatagccataaaagccaggcgcacacatgcaatgtattaagttgaaaatgcatgtctcttcagcttcatatctattaaaggaagaaacaatttacaggttgctgcattatgggagtatgatatgtggagtgtcaaccttttctcttcaaactgaaccatgttaagtaaaatcaatgatggggtttggggggtaggggaaggaaggggaaaagcagggagaaagaaagtttttaaaaatctctgcctcagcaaaagttttcattaaaattttagacaaatcatccctgtgtccttctcccttgctgcctggggctccatgctatttctatgcaaataacaacctcgtggtttatatcttattatttccaccggagctgcagcgacatgacctgagatgtgtaagaggtgggggggaaggggggggcagaggaggggatttggagaggagagagaaagggagagaagaaggaggggggagagagagagagagggtgttcactcaagtgtgaaaaaatattgtcaggagtgagcatcaagaacaaaaaaaaattgcagggataacgtgtttatttcagtcccccccaaaaccccccaaccccccttcctgcaaaccagcaccttttaaaattcattgggcatcaggcgatcatgcacaatccatctgctttcactttatcatttgcatttcatgcctcctggcttttgatgtgctgatactttgatgcagtcaggagacgtgcattatcattatttcaattttcaaaggggtcaacaggatcggcacttgcacacacaagatttttttcccctacaacctctgaacacccccactccttattcttcaccccaatgtttaacataaaggatgaagactcaaaaatgtgggggtcaaatatttacagtctaagactgtatataagcttgcatgtctcctacatttccaccttacacaggtacatactatgagcaaaatggccaaggcttaagaaaggaggctctataatgtttcaaaaacacaaagactttctcacacatgaacacacagggcggcacacagacagagaaagagggggatctatacgcaagacacagacacaaagagacagaaagatcagcacccacacagaaagagacatgcactcagggtgacttgcacacacccaaagtacacaatacagagagatacctacagaaagaaaggcaaacagagatgaagaaaaacaccagcacacacaaagacaacacacagaaggagtgagtcagaggaagccatctgagcatggtagtttccttttttcataccttataggcaaaggggctaataggatattctgaacgaatttgcataaaatcgggtgtcttcagcagcacagctctatacttaagaggagctgacatgaagatagtgaagcaggcagagcaacattaggtaacctctgtatctgatcactcccttcagctaaaaacaaatatgcccttttggaagtgagcattgtttggtaagttaaagctatagctttatttatctttcaccctgtaactaagcttttgttttaacaagcagccctgtaagctatgacagtgaatataatgaatttgattagaacaattcaatcagattttaagaaatcaatctctaatgtttcttcatggcacaaatgaaattcaactagcaagttttcaagcaaaacaaaaccaaaaacccaacatctgctttttgtaatattctttgtatataatatagtatcggggcaggggggagaaagaaactcaatataagaagatatatttcagaaattagctctctgactgggtatgggaacatcatggaaatataggtttttaaagtaccattatctatgagaacagaatttttaaaatctttcaaaaattctgttctcatagataatggtacctaaaattatctttggcattcatcaatatctcatcctaagaaggtatccaaaagagcaacttaaaaaaaaaaaaaacaacaaccttaagactctcagcagtttctcccactgcaataataatcttcagtagtagtggttcacaacctttatttccaggctactctccaaaaagggaggaagacagccaagttcgccactgttagcactgctgtgcctttccttgatgagaaaagcaagcccagaggaggatacagagttcatatgaatgcacagagcaagctgatcgcatcaaatgattcctctaatttctgacatccacaaaatctaattaaaccaatggaattatcaactttttcctaaatgggaatgacagaacacttaattcttacccttaaacttgaaagtcaagacttgataaaaagttcctgcaagtggagtaaacataatatctgatacaatttagtatgtgtattaactccataagctcaatcaccaaatcatgttagagagaggaacgggaaactgaaatttgaatgtgggccaacactttttgccaagaactaggtactctttttttttttaagagatggggtcttactatgttgtcaggctggattcaaacttctgggttcaagctatcctcctgtttcggcctcctgagtagctgggaatctaggcatgcccagtagaactaggtacttttacttatgttttctcatttgagctccacattatttaaaggtttaaattattatccccctttgacagataagaaagctgaggagctgagaggttatataagttgcacaagggcagtcagcctcagaatattccattatacttttctggccctgaagagaaaataattttcctatgcttgcaaagatgtcagaactgcactgtcctttatacattcaggtattcttggatagttttcactctttcgagcagtgaccttgccatccatttttttcccctttggaaaaacccttgtgaagttggactaaaaaggcacaaatctttctttggaagggaagataaatctttatgcatactctttcccagtaacccatccatgcatccatccacccatcttcccactcaatatttgccaaatatttcttctatatacaagagaccaccatcggtgcccttttcgagaggtgtatttacagatttcacaaaatcattaaaacttgatagtctcaacacctaggccggtacctaattcatgatgtaggcctgaaatgggaaccagcacagctggaatcagagacagctcaatgtctgtgtatagatctcctcacatcttttactaatagattaagaaaaagagagaagtgggacagaacagaagcgttcaattaattctgtctttctacaacgacactaaaacataagcactttagagcagcggttttatatggtttgttcactaacatatacacagggcttggaacagtgcctagaaaacagtaagtactcaaaatagttgataaatgaaatgaatgaatgaatgaatgaataaaaaggcaagcaagtcaatgggcagaaaagatggagggagaggggaagagatagactgaggaaggcacggattgaactgcttccttccaatcaggatcttgaattaagaattcacacaataatcttcaatcagctatgcatacttcttcaaaaccctagaaacttactttgttgagggctccagctcctgttagaattaagtgagaattctcaacctggatggttctctgtcccagccggacaaggtaagccccaatcccaatggcccggcacgtcaccttagaaaagaataaattctacatgtcacatatttatgtcctctctgaagctataagaactaaggcatagataagtaaaatccaaattaacagaaataaacattgctttttatgaagtctatttgattgacaacaacacacacacacaaatttcatggtcaaagaaaagaaaatacaatgatgcaaaattcaggctgggtgcaatggctcatgcctatcatcctagcactttgggagtctgaggtgggcggatcacttgagcccaggagttcaagactaccttggggccgggcgaggcagctcacacctgtaatcccggcactttggaaggctgaggctggtgaattacttgaggtcaggagtttgagaccagcctggccaacatggtgaaaccctgtctctagcaaaaatacaaaaattatccgggcgtcatggcacgtgcctgtaatcccagctactcgggaggccaaggcaggaaaaccacttgaacccaggaggcagaggttgcagtgagctgagatcacgccactgcattccatcctgggcaacagagtgagactctgtctcaaaaaaaaaaaagacctacttgggcaacatagtgagacccccatcactacaaaaaagttaaaaattagttggaggtggtggcacatgcctgtagtcctagctacctggaagctgaggtaggaggatcacttgagcccagggggtaaaggctgcagtgagctatgattgcaccactgtactctagcctgggtgatagagtaagactctgtctcttaaaaaaaaggaaagaggggccaggtgtggtagctcatgccggtaatcccagcacttttggaggctgaggcgggtggatcacgaggtcaagagattgagaccatcctggccaacatggtgaaaccccggctctattaaaaatatgaaaattagctgggcatggtggcactcgcctgtagtcccagctactcaggaggctgaggcaggaaaattgcttgaacacgggaggcggaggttgcagtgagctgagatcgtgccactgcactccagcctggtgacagggcgagactccatctcaaaaaaaaaaaagaaagaaaataaaaagaagttacactaaaagctaaaacaaagtgctgggtttgtttgaaaaattcagttatttatattatcctatcttcctattatcatgtgtgattaaaatataattatagacatacaatcttcaagaaatgctctcatttgggactgaatagcagtgataagagaaaaaaataaacctagccacacagccagttcttcaaaaatttcacattctggaaagatttaccaggctgatggtaatgatctcattataggccaatgaggattctccagcaatcattccagaacctcgaaggttctcgggtccaattccctcttctttcccaataatatctgttatcttgtacctattggatatggccatgtcaaattatgaatgttaaacacagtaacaacaagccattaaaagaataatcaccaataaaaggcggctaaaagtgtattgaaagcttatatttaatgccagggctttatgtgcttccttttatactcttcattcatatgtctttccttcttagcttggtgcctattttacctggaagcaacatggtttaatagaaagagcgaaatctggaattaagcagatagccttttttctttttttttgaggcggagtctcgctctattggcaggctggagtgaagtggtgcaatcaaggctcactgcaagctctgcctcccgggttcacgccattctcctgcctcagcctcccaagtagctgggactacaggcgcccgccaccacgcccggctaatttttgtattttcagtagggacggggtttcaccgtgttagccaggatggtctcgatctcctgagcacgtgatccgcccacctcagcctcccaaagtgctgggattacaggcgtgagccaccgcgcccggcctaatttttgttttttttagtagagacggggtttcaccatgttggccaggatggtctcgatctcttgaccttgtgatccacccgcctcggcctcccaaagtgctgggattacaggtgtgagccaccgcgcccggccaagcagatagatttaaatccttgctctgatacacacaggagtgtgactctagaaataataataacttctacaaaatgggaataataatatctacctctaagggttgacaagaaagttaaactaaagcaaacaaggaaaaggtttgatgttatagatggccctcggattttagatgccctctcttattttctagaacaagtttcttaaaagcaaggtcaatgtatatctctataatgagcaaaaggcatcatatcaacaattttagacaattttacgtaggaaaagaatatccaaacagagcggtagtgagaatgctcagcttagtttctcaagtcaaaaatcctcttctaaggtaggatgaagcaaaggtcaaaatactgaactcccattcatactccttcataaatatcaagtatatacacaagggtccctggatatgtcctctggaggggaaggtggaatgtgtgtagaagtgaaatgctgaccaagttgtccagaaagcatcctgtggatctagtgggagtcactcatctgtcttcctggcaggggattaggagtgatagctgataatgggaaatgggagatggggaatgcaactaataaaagaaaggaaaaatacaaagttggaagtagagatgggcatatattatttattgttccacgtgtacccagaaggcttggcagtgggcacagttttataaattgaaataataaataagtaccccatagtggctcttaaaatacttcctcctgcccccatattttcctgctcccttcttcatttccagccctccatcaattctttttctttgcccttgctgttggtctgtgactttgcatctctgcttcccagattctgctgcctttctatttttagcctctcctaatatccaataatttcccagttcttccttttgttctgtatctagactctatcctaaagttatgtcagaaatgaggctactgtcccttaagggggttaattaactacattaattgtatatgtgtttgtgtgcctgtttgtataaggtccatatagtcataaatattcaaggacccagccagacttgcctgtaacaaactcaatattcatagattccagaaatgaagagttaaaaaatatcataggggaaaatcccattcagagtagcaagaaaaaatgcaaaatatttagaaataagcatgaagaaattggcagaatctcaccgtaactatattgtgtctcagggcaccatgatgaactcccagaagcactacaagatattttaaatttttgagagaagcactattatatgtggtatctgtgaccctatgtgaactactagctttagatagttcatagtagttcacagtttaacgttagaatggtgctacattccttttgaaaatgtcctgtctttgcaagctagatttttgaagtttctgtgaaaactcaatgaagaacaagaaatgtgggtggctatatccaagctgattccaaggtttgagaggttatgcagacacaaatatctcattagtaagaaactgtaattatttaagaataaattttttcgatttatgtatataattttttcaaatgattattaagttcttaggacgcaaatacttattgtttaactacctaataagcagaaatattaagtatatcttatagcccaggggtgctatgaaaaaattactgagacactaaggatgccatgaaccaagaaagtttgggaacctctggcaaaacctatatgaagaaaactacaaaacgtaaaaacaaaacaaaaaaaaccccactcatataaatggaaaaacataccctgtttctttttggggaaagttagtattatgaagatgtcacttcttaaattaatgtgtaaactcaatacaatctgaatcaaaatcattatggaacttttttggaattagaaaaacatgagactctagccaaacacagtggcttgcacctgtcattgcagctacttcagaggttgaggtgggaggattatttgaggtcaggagttcgagaccagcctggggaacctagcaagactctatctctaaaattaaaaaaataattagctgggcatgatggcacctgtctatagtcccagctacttgggaggctgacatgggacaatctctgaagctcaggagtttgagggtttagtgacctatgatcacaccactgcatcccagcctaggcaacagagtaaaaccctgtctctaaaaacaaaaaccctctacattaaaaaaagcaaaagtagccaataatacttgaggaaaaattaaaaatgtgagaaaatttgcctcactagaatagtttaaatagtgtggtattagcccaagagcagacagacagaacaaaaaaacacaaaagagtaaattttcagtaaatagtattaggacaattaacttttttttttcttttttttgagatggagtcttgttctgtcacccaggctggagtgcagtggtgtcatctcggctcactgcaacctctacctcctgggttcaagcgattgtcctgcctcagcctcccaagtagctgggattacaggcatgtgccaccaggcccggctaatttgtatatttttagtagggatggggtttctccatgttggccaggctggtcttgcactcctgacctgaagtgatctgcctgcctcagcctcccaaagtgctgggattacaggcgtgaaacactgcgcccagccaagcaattaacattcttaaaaatacttgcagatagattatataaaaacattcaacttcactgggagtcaaaaatacaagttaaaataacaattgccatttttattccattttattaattgataatcaatgttggcaggggtgaagaaaaattaaagagggaaacaaatcctattctacactgctgacagaaatgcaaatcttgggaaggcaatttaaaattattttttaaaatccttaaaaattgacttttcgacctgcaatttctcttctagaaattaaccaaaaagggatgatcagagcttttaattcctaaaagtttatatgaaacttatataaatgtcccttaagtgggttcagccaagggatgtgaaaaattagaaatagtctgaatgttcaaatatatttattataataaaatactatgtagacattaagcatcatattcttaaataatgttttaagaatacacgaaatttccccaaaaatagtttttagtgaaaaggataaattataaaagaaattcttgttatcatctcaatcacatagaaaaaagatatgtctatagaaaagacagcaagtgtataacataaattcataatcgtggcctgaaggtgggattgtggctaatttttttttctttataattgtttacatgtttcagtttttctaaaatgaattaagtattataaatttaaaaacttcaatcaataacccaaggttcttcagctaataagtggtagagctggatgtaaacctaaaacatctagattatgtcatcttcaatgttcttcaaggttatgaacagctgtacaatatggaaaaaaataccatattctcctttctttagtcatgaccaaattattccaatacatatatacctacctggattctccttcatcttccacgtgttcacaatggacagagttgagagcactgactctcttataatcttgaggagtcagatataaatacctgtatccctgtgaagcacaaatagtttttaactcattatttgccattgtcatataatcagaagatacagcaaagcatacataatgaagcttgttccacagctagctttaaattgccacatcacttcttaggtttactgtctaacagaatactagcacagacagtcctcctttgaaagatgaagtgcctattttttcactcactaactgtccttgaaacaagacaccttatagctgcaattccaagtatattcccttcatttcattttctttctttctttcttttttttttttttttttgttgagatggagtctcactctgttgcccaggctggagtgcagtggcgcgatctcagctcactgcaagttccgcctcctgggttcacaccattctcctgcctcagcctcccaagtagctgggactacaggcacccaccacctcgcctggctaattttttgtatttttagtagcgacagggtttcaccgtgttagccaggatggtctcaatctcctgacctcgtgatccgcccgcctcggcctcccaaagtgctgggattaaaggcgtgagccactgctcccggcctcatttcattttcaacagggttaaagggtcattttctgatctttagtgacatctcttaaagatatcaacatgtaattaaagaattgtgtgaattactatttttcactctctcaaatccacaggatcatcaaaataaatataagcaagggataacagaaaaccgcaaatctaggagattcaatattaaaatcagaagtctacacagtgctaatagtgaacactgaactcagatcttttgttttttcaataaacaactcctaatgcccatttacatgtaaacaattatactaacatttcataattgatttatatgtatctatacacacagccacatacaaagtagagttacatggtatatgtgtttaacttaagtgaattagtcactcagtcaaaaaaataagtaaacacagggaagcattttaaatactatgagaaattatgcccaccatttaactcaataaatgtatgtcccacagtgagcacaacatggaaaagacataaatctgcgattggtcttgcatgatttgtgttgagaatgcctgacagcactgagtgtcattagtatgtcagtcagtacacatttactgagtgcctattatgtacaaggtactattccaggcactggaaaaacaggaattaacaaaaatagacaagaattcctacccttatgaaacatacctcctactcggaaagtcaggaaatacacaaaataagtaaaatgtataatgtaaatgggaataacgtttaaggaaaacaaaatgaaagagaaggtagacagtcgaacttttagaaaaaataaccaaggaaagcctcattgaaaagtgtcatttgagtaaagacctaaaggagctgaggctatgagacatgaggatatctgaggaaaaagcattctaggtagaaggagcagcaagtacaaatgcactgaggcatgatgtgcttcgcaggtttaagaaagcagagtcgggtagagccaatgtgtggaatggtcaggggaggctgtagcaagaaatgagggcagagtggtactggaaagccaatctatgtaaggccttgtaggcaactatatgatctttggcttttacttgaatgaattgggaagctattaaagggttttaagtggagaaaaattttgtgatctgatttatattttaactagatcattctatcttttttttttttttttttttttttgagcagagtctccttctgtcacccaggcaggagtgcagtggtgcgatcttgactcactgcaacctctgcctcctgggctaaagtaattctcccacctcagcctcccaagtagctgggattacaggcatctgtcacaatgcccagctaatttttatatttttagtagacagagggtttcaccatgttggccaggctgttctcgaactcctgacctcaagttgatccatctgcctcagcctcccaaagtgctgggattacaggcatgagcatgagccaccacacatggcctcattctacattctgttgagaacagaccttgggtggggctgggagcaaggccagaggcaggaagaccaattaggagggtactgcaatatgcaggtaagaagagttagactactgctactgctagtaagtagctgtggaatttgttagaagtactcagattctggatatattttaaggtagggatgtaaacatgatttactgtttagatggatgaatggggtgtggaagtgaatgtggggtgtgcaagaaagacagaagtcaagaataactccaaggtcttttacttgaacaaatgaaacaatagaggtaccatctgttgagacagaagactgtgggaagaacacattaaaggaagattagaagctacaatttaggcagacatttaggcagatgtaagtagagatgttgagtctggatatatgaatcttgtgttcaggggtaagatataaatttggaagtttatcagcttgtacatgaaacttaaagctttaaaagactggatgaggctgggtgcggtggttcacacctctaattcctgcactttgggaggccaagatgggcggatcactttgagctcaggaattcgagaccagcctgggcaacgtggggaaaccccatctctacaaaaaccaaaataattagccaggcatgctggtgcatggttgtagtcccagttactcaggagggtgaggctggaaaattgcttcaacccaggaggcagaggttgcattgagccataatcgcaccactgcacaccagcctgggcaacacagtgagaccctgtctcaaaaaaacaaaacaaaacaaaaaaacaggatgagatcaccaagggaaggtgaataggaaaagaggagtagtccagggaccaagcccttgaatcacttttttccttctaccctactttctatattggctgtcttgccaaaccaccaggtgagagggcattgggtcctagtggggttgagaatggggagtccagaacttcttggtcctgctgcagcctctgtgctcctgacatgtctccattcacttttttttataattaaaaaaactggccaggcacagtggctaatgcctataatctcagcacttggggaggccaaggtgggaggatcacttgaggccaggagtttgagagaagtctgggcaacacagcaaaaccttgtctttatgaaaaataataaaattagctgggtgtagtggtgtgcgcctgtagtcccagctacttgagaggtggaggtgggaggatcacttgagcccaggagttggcagatacagtaggctatgaatgtgccactgtactccagcctgggtgacagagctagaccctgtctcttaaaaaaaaaagagataaaattaatataacataaaattaaacattttggtttttaaagtttttttttagtctcactctgtcacccaggctgagtacaatggcacgatcctggctcactgcaacctccacctcccgcattcaagcaattctcatgcctctctacctcccgaatagctgggattacagacgtgtgctaccatgaccagctaattttttatattttagtagagatggtatttcgctatgttagccaggctgatctcgaactcctggcctcaagtgatctgcctgcctcggcctcccgaagtgctgggttactgcaaccagccaaaattcaccattttgaaatgtataactcagtagactttagtatattcagatgttttgcaaccattaccactaattccagaatattttcatcagccccagaaaaacccctgtactggatcaattcccatactttaataaagtttttctatgaactttattgaaatataatttacatgcaataaaattcatcagttttaagtgttataacttgatgagttatgacaaatgtatgtacttaggtagccaccaccacaatcaaaatatagaatatttccatcatctcctgaaatactcttacatttaaagatgtgaaaggcagcaaaggaaactgagaaagaggagccaggaatgcaggaagataaaaaggagactttgggctcttggaagccaacagaagaaagtatttcaaggatgaaggaatgaccaactgtgtcaaatgctaatgctattgtcaaataactaaggtgaagactgagaattcaccatagaattcagtaatatggaatcactggtgaccctgacaaaagcagcttcagtggaatggtaagggtgcaagctcaagtgaagtgggttcaagagggaatgggagaagaacatctggagacagcaagaacaactcctttaaaacaattttcctgtaaagggaaggaggggagggacagtgactggaggggtgtttgtatgctaaaagggctgatacagtacagagggaaaaagtgctgatgcacaaaagagcaggaggaagtgttgatcgtacacttaagttagcaagaaaggagatcaaatgtacaagaggagggattgtctttagacagaagtaggaactattcattcaaagtgtggaagagaaggtgaagagtaagggcacaacggatgcaggtacatggaagcttgtagaagctctcttctcattgtttctcttttcttgaaaattgggaagcaaggtctgatgatatcagctaagagtggggagagggaagtgcgtgttacaggtttgaggggagagatgtgaaaccgtcatccaggaggttgctaagcttgaatttaaagtaagatcagtcaacagaactgtttttttctccatcaaagttcagctgggcaggtgcaggcatgggagcagaatggagagagttggatttaaacactctgtaaaagcacagagtaagcagagtgaagagagaagcaagttgaagcaagttgagagagaaagttgaaggtgcagaaaagatggtgattataatgattaatcaaggactgaccttggagtttaagccagataggaatgaaatgaggtgtaaggagggagtgaagaacagaagaaaggtgggaggataaacaggtgagttcaactcaatggtactgatgatttcaaaggattgttggactagagagaggaagctggaaagagaggatggagggggtagcaaagaaagagatacttgaaattgagattatggggaatgagaggctgagctagggtataggacagaaccactagaagaaaagaagtcaaggatccaagaggccagattatgggaagaatcatctatgtggatatagcaatcaccaagaattatcacatgactattagtaatggacagagtggcaatgtgccaggaactaaaagatgcaaagaatgagagggagtgaccaaaggatcaggaaacacaaggagcagtatgggtatggcacagtctgatgacatgagattcaaagatgggattttttcagagagaagggagaggtgtctggaagcagcaatgaggatcaaggaggacaatattccccttccaggctcagtggttcaaaagaaagacagaaatcagtcagtacttcagagggctacgggggaagcaatatctttagaggagagacagatctcaaggtgaacaaggaggttggagcagaagatgaggaggtaagggattttgttgataattgaccgtaagtcctggaagccacaattaaataaagatatatatttttgatttagcatgtctcgcactaaatgcatacctactatttcatctagtgctcaaccaaagaaacagcaacctgttttatagatggaagaaaaaccaagtgaacatattgagaaataatttgtctttaatatggtgtcttaaggaattttcacaaataattttgtttatatttaatttttaccataagtggtgatttttgaacttaaacctctacccttcccccacctctccacacatgtagcataaccatatagcaccttgaagtagtatatgctcttagtgtgtaccttgtaaggatcctcaggatctacccaggccacatgaaacatatggcgaatttcttctgccagtccgattcttgctccactgttggctgatacatagatgcgtggaataccttctgccctagcaagttcggaagctctgagaaataacaaatcctcttgaggcccaaaggacccaattcggtatgtgatgtcattgccaataacaatgatatctcggccttctggatattcaggacttttaaaggtcattttccaagctaccatgccaatctggaaaggcataaacaaacaaatgaacagaagtttcttacaggcagaatttttttcaggttcattgaaggtatcagagtatacctaggcacagccattatgtaaagatacacattgctaaagagccaaactccctgtgggaaactacaaaagacattctagtatactgctagattatgctgagaacagctggtctactgtgtatttcaaaactgtctcaattccttctttgggcctgctcaaagaagacagaaaagccaaaatctaaatgcactcaggatacatgtggaagaatgccatggcactgttgattaaatctagatatctcattttactgccatatatactaagacactgatatggtttggatgtctgtcctctctaaatctcatgttgagatatgattcctaacattagaggtggggcctggtgtgaggtgtttgggtcatggggtggatccctcatgaatggcttggtgctcccctttgatctgagtttatgctagatctggttgtttgaaagagtgtggcctcttgtgggtgaaagcaagcatgaagagagtgctatgaacgccttgggcacactacaagagtacaaggtggtgggttgctgcctgcccacccccaaatgccacatgctgcccttctatggtatgcgaatcttgcacctaatcatgtcattgtcaagtcccgtctctggtacttggtatctcagctaaagaagataaggagtcttcagggaaaattgtctactgtaggtaggtgtttgagaaatcccccctgcaggtgaagaaatctggcatctagctgcactacgactcccgtagcagcacctacaacatgtactggatatcaggacttgaccaccatgggtgctgtcatccagtgctagtgagacatgggcacctggcatcacacacaggcccactccacccagatcatgaaggtggagactgcggccagcaagtgctgccagctggcggtcaaacagttccatgactccgagatcaagttcccactgccccatggggtcctgcatggttagcataagccatacttcaccaccaagagtcccaacaccttcttctaggtgcagggccctctcacccaggtgtggcttaaattaactcaaaaatgtcacggtgctaaaaaaaaaaaaaaaaaaaaaaaaaaaaaaaagagtgtagcactttgccccccacctctctcttgctccctctcacctctctcttgctccctctctcaccatgtcatgtgctgggtcccccttcaccttcctccaagatcataagcttcctgagacccttagcagaagcccaacagatgcagttgccatgcttatagagcctgcagaaccatgatccaaaaataaacatcttttctttataaattatccagcctcaggtattcctttatagcaacacaaatggactatcacagacactatttccatcttttgtgacatttgttccaagaaacctttaacacacaaggaagcagaaaaaggatgacgtctcacggactgtacacttttcatgatccaggctccttgtactgtcctctagcatttgataggaataacagaaacactctttactgatttgtttcaggtatgttccatttctgctagaatttaccaatgctcaacattgcatccttgtgagcatctcttgctttcttctagcaccagaaaaaccaaaggatggaaataactaatctcttgctgcactatatgtaaatctctgctctctgttcagcagcatctggccagctacacaaataaatgatattgacttaaaaggcagaggtgacatgtctcttcccaaactctcacagccctctcctgttttaatccccttctatatgagaactagtcaatccttctacttgtatatttgctagttccatttcttttctatgctattcattcatacgctagttacagctgtagtttttcatgtctgcctgcctgtttcccctatacctggataagtaatgttttccattctttttttccccctttctttctgtctctcacccccctccttgcccccaccactcgccaccaaacacaaagcctacctaccagatgagcttccctggtcctgcctaatggagccccagccacatctgcagccttggtccctcatccccaggctgctgcatatcacctcattggggagctggccatcaagaagggccattaacagatgtaaatagcggcatccctggaaagccacatgcatcacccagactcaaccaggccagtgatcataagctctgagtacacattcctcaatccaattgcacatccactgtaatcaggctggttgaagcattctacacagctatttgtgattctcagcattaggaaatatatatatgaaacaccctcagataaatataagctatttaatatatcataccattggccaaatacaagtcaaaatggatatgatacacagaaaaaaatccaatcactttctaagataaggtattactctatctactcattaaagacagagaaaggaaggaaaaatagatcattcaaaaaataacacagtgaacactcaaatatcaggataattttggttgtggtttctaagaagctagttaatataatccctgcatgaggagaaatgctttatctgccttcacacatgcccctctaaccccaaaccttttgtttttcaggaatgaaaagctattttctgtcaattttcctctaaatgcatttgtagttagaaagattgcgttttacaccaaattttatgatatattaaccctaggcacataggccagaagcagcttagatacaagccctgaagaatctacttcagcatttgtgtgctaatgtaaacattgcgaccatgtggcactgggcaggcaaataatactcttatctttcattactacctggggactctaactgtgtcacttgggcagcaagttcagcaattggctaggtcattatgcttgcaatattgacttctaattaggtgtcagcacagcagcaccaagaacacactattctttatcaatgtctttccaaagtatgttgctcatcgaccgcctccccaccccgccccgccccccatcttaaaaagtaccattacagaatggagagtgttatcccagtctcagtgcagcaagattcctgatcagaagacattcagttttgaggtagcatgatggacaaacatctaagaaagcactattattcaatttacattaaaataatttagatttcactgctaatcaaaggatagggcatataaaggtgaacatgggctttggagtccaacaaacttagatccaaatccaggcgctatcacttatattaactaactgtgtgatcttaagaaaattatttaattttactgagcttcaatgtccccacatgcgaaattaagaaaataatacccatgggtttgataaacacactattagaagcagaaatctactatattaacttctacgtaaaaaactttgtctttctctctcctctcctctcactctgtccaaatcttacccattccaaaaggttcatccaaattccatttcctcagtaaagcttctcccagcctaaagtaattcctatcttttctgatctcctactaagacctctgtgtagagaattttttttttttttttttgagacagagtctcgctctgtcacccaggctggagtgtagtggcacaatcttggctcactgcaaccttcaactcctgggctcaaggcaatcctcccatctcagcctcccaaataactgggactacaggcatgtgccaccatactcggccaatttttgcatttttttgtagagacaggattttaccatgttgcccaggctggtctcaaactcctggcctcaagccatcctcctgcctaggcctcccaaattactgggattataggcgtgagccaccttgcccagcctgagaattcttctgataactaattatatgctgcctaggattgcttttggcttaccatcttgaacgattatagcatctcctctagtgcttcccaggaacattaaacatagtctgggagtaataaatgtttgctagttccagagtctttttattttttcaatttaatttttttttttaagacagggtcttgctatgtcacctaggctggagtgcagtggcacaaatacagctcactgaagccttggcctcctgggcttaagtgattctcccattcagcctcctgtgtagctgggaccacaggcgtgtgtgttaccaccatgcccagctaattttttttattttttgtagagatggggtctcaccatcttgcccaggctggtcttgaactcctggactcaagtgatcctcctgtctcggcctcccaaaatgctgggattacaggtgtgagccactgcaccctgcctcacttttaaaaataacacttgaaaaatacttaacaccaagggcttagaacattgccacttatattttaggaatcatagaataagagtcctgaatattcttaaactattttattttaaaaataacaatagctatcataataactaccattaattgaacatttactatctgctgtactgttctaaaagttgacaactactgatagtggttaagagcttaagctgcaaagtcaagctgtcttggttcaaatctcagttttatgctagctgtataaccttggacacttaaccttttacagtttcacttttccaattataaaatggggatgacagcacctttctggaggtattgttgtgagcaacaccatgttaaactagtacagagcctggcacacaaaagccctcaaatggtagtcagtattaattcaaaggtagctgtaattattgccatgaggaaattaaggcacagaggaattaagtaacctgtccttatagctaatgtgaattgtttacttattttttttttgagatggagtcttgctccgtcacccaggctggagtgcagtagcgtgatctcgggtcactacaacctccacctcccgagttcaagcaattctcctgcctcagtttcctgagtagctgggattacaggtgcatgccaccaggcctggctaatttttgcatttttttttttttttttttttttggtacagatggggtttcaccatgttggccaggttggtctcgaactcctgaccttgtgatccgcccgccttggcctcccaaagtgcttattttttaaaaggagtttcacatacacaaaaatggtattttcttttttttttttttttttgagacagagtctcaggccattgcccaggctggagtacagtggcgtgatcttggcttgctgcaacctgtgcctaggttggagtgcagtgatgcaatcttggcttgctgcaacctccgcctctcaggttcaagtgattatcctgcctcagcctcccaagtaactaggattacaggcacgtaacaccacgcccggctaatttttgtatttttagtagagacgggatttcaccatgttggccaggctggtctcgaacccctgacctcaggtgatccacctgcctcggcctcccaaagtgctgggatagcaggcacgagccaccgcgcccagccaagaaatggcattttctttactagagaaattaaggaagtatgttccttaattaaaaagatattagtacaaaaactggcaaaaaaaaaaaaaaaaaagaggtctgtggtttatttaatacaattgtatcaatatttatttcttagtttggtaatcatatcatggttacataaagtgttttaacattaagagaagctgggaaagggtataccagaactctctaatatgatctttgtaactttcctgaaaatctaaaattattttggagggaagtaaattggatagtaagatcactgttagtgttctgtacagccttataagatgatgactatgaagactatgaatagcatttaaaaatacccatgatgtaatactaaattagaaaagggttcagactcaggagccacattctgagactctgaatctgaatctaagataatttgacagaactgagactcagctttctagccatatacgctaaggtaagttatcaacctccctgtacctcagttccttcactggtaaaacaagggtaataaaaatctacggcataagtttgttgtaaggattaaatacatgttaagtcctaggatagtgcctggtatatagtaagtgcatagtatgaatgacaacttcatcaattgaaaagcactttgcggggtaaaaacaaaaataaataagaaacagcaaaatgaggtgataattattgggatgatgaaattgtattttttttccattctccaaattttcttttttgtgtttatattgcattgataactttaactttttataaaataaaaaataactgagaaaagaaaactaccaaatactcttcactgggtgataggtacatgggagtttatattatttatgcctactttagtgtacgtttgagcatttccataacaaaaaaaaaaatttaaggggggaaaaaaatctcaccagcctaattgatttcccatattttagaggaactaattctagattttagtcatactacaaccgatcttatttatataaaatttgaaagagataaatgtatgaaaattaaaaatcaagactcactttaaagagaaagaaatatcaagaactacgttagtttgttgggttatcatttcattttctaaaaagaaatgctctgcaatgatgtggtagagtgtaaacatatgtatatataggtttatacaatattaatgtctctacctcagaagtaactgcttcagtgtttttctggtctgatggttaaatacatatttatatttttaaagtcaatatttgtacaatagacaagaacagtgcctatcagctaaatacatatttaggactgtaccacatgtattacaaacatgtactaaaatcgaaagcttttatttatacagaacctttcatcttgaagagggctaaagaactttacaaacatatgtacataaaaggacgtttgcactgataggcagggaaggtactcattcacccactcccctatttcttctaccagtcctgggtaggaacacatggtgtcaacagatgcaggtctgtaacagctgcaaagacatacaacacaataatccagttgtgatgcacagtcactgagaggaagcttgcaacttgagaatagcaacagctctcctccagtgtagaagcaccatagccatttccagctttgtgtttttaaattattctctacccaactcaactaatcacctgacaaaattgaatttgatactggaaatggtttctgaatgcaaaatactttctgtctgatgatgaaaactagattgaaaaatgcttccctctgcccttgttagatttaggaaaaataaaaaagggttacaacattcaggagaaatggttcaaaatattctacctaagaatagcttcatctcaaaggattagatcattgctttggaagagagtcatatttcactctctaattagtacactgttaagtttttcagtcaaattactttctatagatgggtctatctatattatatacataatggagatttcatatcgaaaattctacaatcactataaaagtatacacagtgtgacaatgtgattagcaatgtgacattcattgatttcacctaagcccaatctgcatgtatattaattgaagaataatgactaacggagaccccatcattaaatccctctttttgggggtcttctctttctctccaacatttttatccaggtgaaacccagtgaaaatgacatgccaggactaagagctgaaggaagatggaagagctaagaaattaacaaaaaggtaccctgtagcccgcatgtaagtgggtgggtttatggtctaatgagttttagactcaaacgggcagtgccagtgtcgtcttctctgatcactgcctctctcatgcactgactaaacaagtggtcctaggtacttactacaaattattttgtcattactatagccatgaataagttttaaaatatttaatttcagatcatttttcataacagaacattccaacgagcaggtttattaggtttagggttatcaacctaagctgattatcttaaagtgaaaaagggaagaggatgaaaagagccacagtgaataagctaaggataagcagaaataaatatttgtttcccttatacaagttctaaggcagaacatatttctttggctacattctgattctggaatgaacagctcaagtgagggaggaggggatgggaaggagaaagcaagcagaagagaacagtcttatttaactgtttttatgtgggtaaaatgatttgtgccacagtatttccataagaagtgggaccattattttcctgtagaaacacatttggtttgaaaagtatcactggacaggacgtgaaaatcaaaccaaatgaattattcacaacctccgatcagaggtgatcattatttctgatgctccaaacagtgattaggattctgccctgagatgtcattttctcgctgagtaacaccagcgatacagaaaggcattatctatctatccatatatgtattttttctgctgggaggaccttggtttaatgttactataacagatagtgaaaacatgataatattaacatttattctgatggtgcccataaatgccattagtctgacacaaagtgtcaacactaatcatgacccaaaattaacaccaaaattgacatcaacattaattgtactatcaatgtgaatagaatgtgcaagcacacacaggcacttcccaaagctgctgttgttactacaaaataaaacaacaatattaagctcaacaaagaaatttgcaggaaaagctaagggcaaaacatgccaggattttgttttttaagggtgaaagacatatccatcaactctagctatgctgtgggaagcagaaagagaatatctttgccacagctgcctttcttacatctccacactttgacttgagctctaacaatacctttccatacagatttaaatacaggttaggctgtggctgagatgttgaagctgtattcgttatattcatgctaaaagccttgctatattcatgctaaaatgatcttgagttttttttggaagagtctgtaaaacctattgttctaattctgctaatgccaggaagatgactaccctgcaaggcccttgagcagcaatacaaagaatccaagcatgttagcgctaacccagacttgggcatcatctgcatcataaagatgagaaaactaagatccagagagcaggaatctgaacttgagtcccttctcagatatataacaaaatgttacctctttcccccttttgtatcttgtatccaagcatgaaaaaaagagtttttcagctcttaagaaaattattttgagctccttcacatgatcacagaacactaaataatagaacattgatatctggcaaataatacaatatggaaaggcattgacatatttttcagcatggcttttccaaatggcacaaattaagtcaaatattgtattttaagccttatggcttacttcaaaaatggctgaacaaactcacctcaacctctctaaacagcgataaaagggtaagaaaaatataacttttagagcaaaaaattttcatcccagaggtaattctttgaaaatgttatcaaagattagaaataacaattttgaacagggaaattatttctccctgtaacatttatatacatgaaaccacagtaattttacacatgtacacacagtaatttaataagcataggaattattttttaacaaacatgcagtggagcacatagaagccagcggtatttgagaaatggggcccaggattaattggttggtatggaaattaaccaagttggcctactatagtcccagaagccttgtccattaatcatacgaatgagtgctgaactctggtgccccccgctactcctcattctctggtgtcatctgttgctgtcctgatgttcattattgcctctggttggagctgtaaagtttcttgacatagggtactatgtcacattctttttcagtaaaatcttacaacttaagacaggtataaatatgctggcaagtacattcttttgtttgaaggctatctctagacttatttttgaaagaaactgaggagccctccacaagtactactttagtgagccagtggatgcattaggattttcaaagtcaatcaaggttactgagcctcattttgctatcaaaaaaatgagtaaaaactactcaacctgatgagaaatctccaacaccaataatagtcattcagaaggaattctgagaaaagtatatacatcccaaaagaacagtgtcagaaattcattagaagtaattccatggtaggaagacttatttttcaaaattagcctccatatttttctaatgagggatccaagtttggtttggaagatcattttagacaaagacttgcagccaaatatacttacttagaatgggaataaaagaacaaaaacatagaattaacataaaattatcttaccatatatgccataatatatctttctctatacttaatctcaaggattcaaaattgatttttcaaagccttgatgaaaaataaggcaagcacaaattatgaatacttatgtataatcataatcatttatggataatcataattatacataatcatatgtatttgacccttttctgctgaggatcccaaagcacttataaacattctcctatctttagggacagattaatggcaaagaccctttttataagttgaacaatcaatgcatagaccatggtcctgttttacagacccgcttcgcttaggtctatttcagaactcaccttcagcatagtacaatttaaatatgcctcttttctaacacatatctaaaagactgacactgactcaatttctatacacagcatgaaaaggcaaactgatttcaaaagaatgaaacaaaagcaaggtaaagtacatccaaattagcatcacattcatggagctattttgaggttaaattgagtaaaacaatttaaaaaatctaatgttaaatatttgggtcctgtgttcatgagaaatggcctacccttttctcaccaccaaaacccgtaagcatatacacactctctacaggcagagttttagaacataatgctttccactagaatctgagtccaggataacccaagcaattcctttgagggtatggaaaatgtcaaccaagtgaattaagacagagggttatggtggtttttctaaaataagaggtcctttgggttaagaggtccagcctaagaactgtcaaaatggatctactaattaatttcttctaatcttttaggcttatataagcttaccaacttcctttccctaccaactcctaaattgtttttttgatactcaaattagagattcaaaggattatagtaacatgtaagtgaggagcccagtcaaaatggtaagatttgtttaagctggtcagtagatgcaggggtatttgtcatatcactgtgtatttttttatatgtttaaaataaaaaaattaatgagatgctatactttgggagacataggatatcagtacattgccaacaattaaaacaataattaaatatgggtattagttgggctagcagttctaaaactgaacccctaatccccactgtccctaccatttcacccctgagaacataaagcaggactaaaaccaaaataccagtcatgatggcagctagtctttttttttttcagccagagtctcactctgtcgcccaggctggagtgcagtcgtgcgatcttggctcgctgcatcctccacctcctgggctcaagagattcctgtgcctcagtctcctgagtagctgggattacaggcgcctgccaacacgcctggctaatttatatatatatatatatatatatatatatatatatatatatatttttttttttttttttttttttttttttttttgtagagatagggttttgccatgttggccaggctggtctcaaactcctggcgtcaagtgatccgccgaccttggtctcccaaagtgttgggattacaggcatgcgccaccgcgcctggctgtcagctagtctttaaactttaatttacactactttatttcctcttcaatcatcctcttctttaaaaaaaaaaaatagatccctaatgcaaggttcaaaggatcttcaaccaaagagttaaaattgcaattgcttattgcaggaacactaggtaaaggctactataccaactgaaaaaagaaggacaccagtgaatctgcctcaacaaacaaggccactcacaaggctcatgtgaatgctaagctgctgagaaggaaaaaccctgacacctagcgcccatctgaaaaaatgaaggctcagagctaccacaattcttaagagtggtagtgtgtgtagaggtgaccatcaaattgcattcaatttttttttctttttctttttctttttttttgagacggagtctcactctgtaaccaggcttgagtgcagtggcgcgatctcggctcactgcaacctctgcctcccgggttcaagcgattctcctgcctcagcctgccaagtagctgggactacaggcacccgccaccacgcctggctaatttttgtatttttagtagagacagggtttcaccatgtgggccaggatggtctcgatctcttgacctcatgatctgcccgcctcagcctcccaaagtgctgggactacaggtatgagccaccacgcctggccccagttgcattcaattttcaatatactttcctcccagaaaaacttttataccaagaattccagtctctgaataccaaccccttttttggatatacatcttgtacctaattattataactgcttccaaatacaacatcgcaacatcgtcttctcatctcagtttctcattatgacaggcatgatgagacagaatgttaaaaagctgcccatgttctgatatagtaagaaaaacagggtcctaatttctactagcactaaagttactatggtagttgactctctaacatatctttcagcattgcccactttagagattactggtctagttcgcagagctgataaaaagaaataaaataaaagaatgctagtaacttatttcagaataaacaagagcatagtctcaagaaggctaggattttctttgtcctaccaggcaaagttaagttgttctctgtcaagtccgttacagcccttggcttgatcttagcctgagctttttaataacaggatttagtgcgaaaagcagctgtactggattgcgaactgttactcaaaatgtccccacctgcaattatagcttccaccaaaagatcaaaacaggttagtaaactggcaggaaaatgaaaacaattcctccaaaattgagaagtggtaaagtagaactgttggatagctgcatttcttctgtatccaggctcaacagcacacattcatctagctgtgtatttacatacagtgcccatcactgtaccaacacagcagctagaaatgagatccgtttagtctatgctgcaatcacattttcctcaattttcatctttacttgaaactattaagaaaaatcttggacaactcatctttggagctatctgcaagtaacgtagttcacagatttagtctacatcttttttattcctactctaaagtcatactaaatgtaatgccattcaaatatgacaatgagaaaaatgtgttctcctatacctttcatcatgcattaggtggtactcctttagttacatctttctttatggggaagggacaactaggaaaatagaaaggagacagtagctaatacagcatcagaaaagctctgtctcctgctctaaacacaggcataaatgttcaaaatgcaggtcacatctctactgaaacagccaatattcctcctcaaatggcaaagaagttacctaaaactaaatggaactgaattggtccaagtcctggtcccatcacctttttacctatttactgtcctggaaaaaaaaattagaaagactggccacccatacagccaatggtctgataagtgcaggttttctgccttcgatcatggagaaaagcacctcaattcatgggaaaactctgaaggaatctctcattttacccttactccttacatccatgtgctagttttcaaactcagaaactccaatccttgaaggtaatgcaataccacccacaatgatgacctggtagagccgtcacttttggagaacaccacattatgatgatttaatgtctacatagcaccaatgcatttacattgagccttggctttcagaacattaacaggtcaattttttattcttttgtaataaaactatttctcaaggctctgtccagatgcccattctctttgggacaggacagatttactccaaatctcatcagcatgagctctgttcattcccttcacatcattcttggggtaatatgtagagtgccaggctcatgacaaacttgctctttggccaaagaaaattaaaccgcaatagctgaaagtcaacttgccctgataaaactgggctcagcacgaggaaatacatcctactgacactttgtcatctcttaggcacagctgtccctcagagttctgactgctgaaactccatccttagattggtcagtctctcagtggacatgctccattgtatgttcaagctattggtagcagagtttgatactaacaccccaacctcattcctgttgtgcagtgccctataatctagctaaggccaatgactgacttcaccagccatcctgggcattagtcactaactgctcacaaaagaacatcagtctaactcctcccaagctcaaaggctcagaaacagcaagctaacactcagcctcaatcctagtcaatcatttgaaaagaaaaacagaacaaagaaaataggcaactaaggagggaaaactgtagaacaagaagaaagtgagaactgacaaaaactcaaaatcttttgaagaaatactattcactttctggtttcaaaactattaaagcactggacaaaggaaaacatgtggctcctatactagatctactactagtcatagctatagtcctatgcaactgtttaagacatatcttttccactaaggtttgttaggtcttaaaggggttaaaaaaaacctttaatttttaaaaaattcgtgtgtgtgtgtgtgtgtgtgtgtgtgtggtctttgggtacagaggcccgtataataagactatttgtattcatactggcagagtaaacactacatgttcatgcccaggcagctctgtgcttgtaatttcagcaagaacagagctctgtccctctgggacttcactattccctgagtctccattcgctcaaacacagaatgagggcagaaagaaagcaggaaagaaagatcatggcaaggggtttcacacagcactgcagctagctttcacgtggccaaaaatctcattttgtgttttaattacattagttaaaaccattttgctctcagccccatgttcacaagggtgccttccattcctgaagactacactgttcaatgaatcagaatttaagtctagcacaatgaagcttttctttgctgctgaggggctcactaggcagatgctacatacagtggcagaaacctctgtttcaacttcgtgtgctgatgagtatatatctatgcttgtcaaaatgttttgcatccttccaccccagtcctcttgactttgctatttgttgagactcctacaagtctgatactctccatctggtccaatgcttgcatccatcttgataccaaatcatctactgttggcatccactggcatattactgaaatagccacacaccttgtatatatagtgaaattttttgaaaaagattgagcaaaatagaaacaaactgcttattatttccaaaggtctacccagcctatttgtggtgaaaacacaggtaaagattactccttcaatggaatgaaatctttctagggattatatttaaggttgaaataaaaatatctctctttttaggtttgttactggtattatcattgttataactgtacattaggagcacagttaaaatcagaaagaatcataatgcatggacaagagtataagagtatagggcaaaataggactttatatcactattcataggttactctgagagaaaggatgccaaggctagaaaatgcattcttgggataattatcaaaaaatgggttctttgctacattttttatgtttgaacccctaattctgattgagccccttcaagaacacatttatcatgctcacaacagcaccagatcaaatgaattgagcatggaaaagacactgaaaaatgcatttattaatatgaatccaaataagaaaaaacattaagcaaaacaatactttaaatgttttcattatagaaaatcctggctgggcacaatggtgcacacctaaaatcccagcacttttcggggctgaggcaggcagattgcttgagctcaggagcttgagaccaacatggtgaaaccccatctcaagaaaaaaatacaaaaattagccaagtgtagtggtgcacacctgtagtaccagctactcaggaggctgaggtgagaggatcacttgagacatggaggtcaaggctgcagtgagctgagattgagccactgcactccagcctgtgtgacagagcgagacaccatctcaaaaaaagaaaaaagaaaaaaagaaaatccccaaatttcacacatagacaaaaacagggaaaataatctattttcatgtacctatcacctagcttcaatgatcaactcacgaccaaccctgtttcatctacacacccaccctcacacctctttatttagaagcaaatcattgcatctgtaaatgtcttagtctgtatctctaaaagaaaacaatattcctttttatttttttaaaactgagtcctttgtgttaaaacaatactattttaaaaagcaaaatcataataccattatcacacctaaaaaattaataatttcttgatactcagtcaatgctctctctaaagaactctcccaacaagactaccatgctccagtgctatttaatgaccacctcacagaaagctggtactagtgggcacagagataagaaagggaaggggggtttcaactacttgcctcatttcctcctggaagcctgttcatgtggaccagctgaccttgatcatccagtaccagttcagtgtaagtcagcatgtcagaaggcagagggggagatggaagaaatgcttgagtggacatagactcccagagtttgatcagggactagtggagaaaagaagtttgactaatcagtcacaataatttcaatatagacaaaaataattattaagattcagtcaatctggttttgccttcttttccaagtgttctgcagagtgtaaacattagactaaattctccagctcccattctcagttaaaatagatttgtaattactttttacatgccaaaagtcaggcacttttccaaaaagtcaaactactgagtgattccaaatcagcaccagagcattaacaaacaggaaagacctaacactatcctaggaatattaaaattaaaaaactaaataagtagcatcgactccttaaaacaaagaaaaggaaaatcctaaagaaacttgacaacaaaggaatatccaggaaaatgacatgacgctcagctaataaaaagaaaatccaagaaggccagaatgaagcttctactagaaattccagggaagaaacctctttctaatatttttcatagctataggaccatacacaggaattagctcactagatgtgtgtgactatttgtaaatgtgcagatcaattctgctcaattttgacacagacataccaattcatttaaaaaatattatgatttccatttccaacttcctgtaagtaaatcctttgtgaagtgggagctaattcagctctttctttgcttgcctcaaagcaacatttgaatcccaagtgactcatacatacctatgtgtcctaatcactgtgtttatgcctattatataggaagaattacttagaatgtgatttatattatatttatatagaatgtgatttatattatatttatagcactggcattgggaaacagaagtaacactcagcttttaggctagcaatgctataaaagggaaataccgaatgaaggtatctttcaggagacagaacttgtaaacaaatggttgcataaaggtaatctcttgtatttgtgaataacacaggaattctacacagactatttactacgactacatatattactttactaaaattcaaatgtggtaatactggtagtattgactaggagacttggaaaaatcctatattcatagatttttttaaaaaggacaaattcagtattcttttgataccttattctttactggttgcattttctactggtgatacacttttcttgccttctattgatagaagaaaaatctgcagcatagagatgattcaccatacagattgaaagaatttgttttcatatagaggctgagattcataatgtcatattttctcatgctagtttttattcagctataacaaatctcccacaaaagaacttatactctaaactgtgtaccatgaactctatatccatttgtctatgctatctatattgattctcatcatattaatctagggtatcaactaggaaccaggtttatattggaaaatgagaactaaagtatcagatctcctttttaatatccataatttgaatatagacttgggaaatacacaggtaactcttcacacaagtcactgtaaactatcaccacaagaacataaccttagtttactctctcctgtctcctactcaatagagacttctattctcaccattcctctcattaattcataaagaaccatccaatatctgagttggcagtcaccaatcctcaaatgaaatagaaatgaaaacagtgtcaagatatttcttgccctttggagtgcccccttctagccaaaaccgcatctgatggaaattcagggaaaccttgcctccttagaacatgtcagaccctccagttaggcatcttacctgccgaaacatctctgggatatcatatatgtatgttgtccctaaggattgtgcctggaacctctttgattgcagcaggtctttggtcacatatggagtattgattaacattccatgcagtggtccctgtttgtctccatatgcctgaaacatgatctgcaggaaaaaaaaatggcatggggagttaagagacagaaaaaaatcagagagctgcctagaggggctttttttgcacaaatattatctctttgaaaacatttttggtaggttgagtagctgagatatgcctcttaacactgggtacttggtgctctcacctctccacagattaaccaactccaaaaaatatatatatataaccagccatataccataactgctctcacttttagattagttgaaatcaacaagaaagaaggccaggcgcagtggctcacgcctgtaatcccagcactttgggaggccaaggcgggaggatcatgaggtcaggagatcgagaccatcctggctaacatggtgaaaccttgtctctactgaaaatacaaaaacattagctgggcgtggtggtgggcacctgtagtcccagctactcgggaggctgaggcaggagaatggcgtgaacccaggaggtggagcttgcagtgagccaagattgcgccactgcactccagcctgggcgacagagcaagactctgtatccaaaaaaaaaaaaaaaaaaaaaaaaaaaaaggaaataaacaagaaagcacggtgcacatttcgcatctcaaagacagactgaccatgctagccatctaaagtgagttgaatctcatatactcagaaatgaagtacatcaactaaccagtctgagcagccctggtattgaagttgaagaacagctatgcagtaaagataattctcttctttcctcaatggcagaaggccagatcaagactctagtatatcatctgtgctttagtcctttaacccacttgattagatggtacttcataagtattactagctatgcaaaggcttcaaagatttctgccagaagtggatttcatccatccatctagatagttaattctcactagcccatgagacacagcctcatattttacatatagtaaaataaccatattatattaaattatgtatattaaaaaacatatatatatatatacatgtatttacttctcctcaagatgctgtctacaactagtgaatagctcctgcaatacctatattgtcacataatgaaatcactacactggtttttaatcattttaactcaaatatttctagaggagtgcttcatactccatatatttagatagttttatttgcttatgaatatttataaaggatgccattatttcaattcaattaatatttattgagtgcccagaggttgtataacactaaactaggcacttcatgcatggatacataaaatataaattcccagtgcagtgaatacaaatggagattgggatgtaagggtatgtgtatacctacatatctattcagacctacaaaataagcacaagtctaccattaatgaatagattgtggacctgatatatatgcacaggaatagaattaagtaccttcctaaatcgtgggtacagttcatctgtaaatccttagccccttagctcagaggaatgaatgttctgctaatttgtcaatcaggtcctgttctggggaaaacatgtctcaggctgttttaaagacccagagattggagctcccagtcctcttccacaagatcaataggaaaagtcacccggggggaagcagaattagtaatgtcttaggaatgtgtcagtaaaagcaataatgttttaagagattcaaagtgttaagtaaggcaagggtacagtatgagaaaactgtactcagagcaagtaagctgaatcaaaataagaaaatggggtaaacgcagcaggttcctagaactacatttctcgtctgttaagagagacaagaccttgagactcggtttggccaagctttgtgatgaagacaggctggtcatagttaagcaacataattgtgcactgaggaaggggattggagaaaacaatctagctacatatgtatattgctggcagaaatttaaatggtacaaatattttggcagtttgtcaatatcttataaagttaagcatatgcttactgtgtcccagcaattacacttttacgtatttacccaaaggaaataaaaatatatctacacaaagatttgtaaatgaatgttcacagcagctttattactactaatagctcaaactaggaaataaaaccccaaatgtccatcaacaggttatcttggaaaattagacaatgagaactagagggccgggcgcagtggctcacgcctgcaatcccagcactttgggaggccaaagcaggcagatcacgaggtcaggagatcgagaccatcctggctaacacggtgaaaccccgtctctactaaaaatacaaaaaaaaggctgaggcaggagaatggtgtgaacccaggaggtagaacttgcagtgttgcagtgagccgagatcgtgctactgcactccagcctgggcgtcagagtgagactccatctcaaaaggaaaaaaaaaaaagaaagaaagaaaagaaaatgagaactagagtttcagtccttttttttttttttttttttggagacggagtttcactcttgttgcccaggctggagtgcaatggtgcgatctcggctcaccacaacctctgcctcctgggttcaagtaattctcctgtctcagcctcccgagtagctgggattacaggcatgcgccaccacgcccagctaattttgtatttttagtagagatggagtttctccatattggtcagactggtctcaaactcctaacctcagctgatttgcccacctcggcctcccaaagtgctgggattacaggtgtgagccaccatgcccagccagtcttttttaatatccataatttgaatatggacttaggaaatatacatgtaactcctcacacaaatcgttgtaaactatcatcacaagcatgtggtcttagtttactctctcctactcaatagagacttctattctcatcattcctcccattaattcataaagaaccatctaatatctgagttggcagtcacccatccccaaatgaaatagaaatgaaaacagtgtcaagatattgcctgccctttgggggtgccccttgctagtcaaagctatatctgatggaaactctggaaagccttgtttccttggaacatgtcagagctcccagttagtcaccttacctgccaaaacatatctgtgaatataaacattttgataaatgaatgtaaaaatttcgataaatccattaaatggggctgggcatggcagcttacacctgtaatcccagcactttgggaggccaaggtgggagggtcccatgaatccaggagtttgagacaagcctgggcaacattgtgggaccctgtctctaaaaaaatttaaaaactagctgggcatggtggtagacgcctttagtcccagctacttaggaggctgaggtggaaggactgcttgagccaaggaggtcgaggctgtggtcagctatgattacaatattgcactctagcttgggcaagatagtgagaccctgtctcaaaaaaaaaaaaaaaaatccatgaaacggaatactatccaaaaatgaaaaggaacatacacataatctatgcaacatggctgaacctcaaaaacattatgctgagtaaaataagctagacacaaaatagtacacactgtttgatttaaattctaggataggcaaaactaatctatagtaacagaaagcagatcagtggttgcctaaggccggggttggtgcttctacctttgactgcaaaggcgaataagagaactttctgcagtgatgtatctaccacaactgtgatagtacttacacggtgtatacatttgacagaatgaattgaactgcacacacaaaacgagtccattttattataagtaaattgcacttcaataaaggtgttatttattatttttagaggcagtgtctcactctctcgcccaggctggagtgtggtgtcacaatcatagctcattgcagcctcaaactctggggcccaagtgatacttctgcctcagcctcctgagtagttggtactacaggtgcatgacaccatgcctggctatttctttttttttttttttttttttttttttttggtagagacagggtcttgccttgttgagctggctagtgtcaaactcctgggctcatgtgatcctcccaccttggtctcccaaagtgctgggattacaggtatgagccaccatgcccagcccaaagatgattttaaaatgttatttttcttttttttgagacggattcttgctccattgcccaggttagagcacagtggcacgatctcagctcactacaacctccgcctcccgggttctagcaattctcctgtctcagcctcctgagtagctgggactacaggcccctgccaccactcccggctaatttttgtatttttagtagagacaggctttcaccttgttggtcaggctggtctcgaactcctgacctcaggtgatccatctgccttggcctcccaaagtgctgggattacaggcgtgagtcactgcgcccagcctaaaatgttatttttctcttacactgcacattggaaatcaattcacttatgcaatggattacccaaatctcttctccccattatgactgcctgacatcagtgttcattacagcctatactacaaagactgtacaaggaaaatgaaaaataaaactcaagccaatcaaccttgttccttattggcagaatgaataaatgatgtgctagggcaagaggctgatagtaataggagttcctgaatactcaactatctatgttagttccattttctactataatgaacgcagtaactaaaaactgtaaagtatgttttagaagttcatgaaaatatgtacacattttatatatcacacacctttcaccagaagccatcaaaattattttagaaaataatttctgacccatagtctgctcccttagaacactgtatttatttataatagcacatatttgccacagagaaacaaatcatttgtcttcttccattgtgatgtaaatttcttgagtacagtttgctttttctctttatacgcatagtgcctgacatactataagtagtcaatcaatattaaattaaaaaacaaatgaacgaataacagacatggttctgtattaacttcatacaatgattcattaaagaaagggaaaaacagtttgacaataagcaccatgtaggcattaggagcaccagaactgggttggaggctgctccttttgtcagttcccacgtctagccacaggctcaaaagttagttcccatatggcagtagctcttgaactctctcaagtgaagagtctgtagaagacctcttccttcagggcttttaaaatatgcaggaccctaggtaaaaagcgttttccttcaggctgaaggtggtttgttcattctttcagatgcttattgtgtgcttattttgtaccatgtgtaatactaaaccctgattgaaggcatctgtgcctttcacactcctgtgtcaccattagctagcatgagggaaatctcagagtttcctaataaaggaaaggaaaaaaaaaaaaagaaagaaagtagttatgaagaacaaacatatttatcaaaaacattaaaatctcaagtggccatcttacttttcacaagaatagacctgccttgaagctattgtagaagttaattaaaaacatccctacccattgaaagctttgactgaaaatgtctttaaagttgcactaaaaaaacatcaaatacagcaaaaaatattgaacactctttctcttggtcaccactcacgctcttgcgcactctctctctctgtttttaactgctcacttctcataggatagatttctctagccacctcactaggaatcaaagcacaaaatgaaaggtcattctgactactgtccaaactgagatttttaaaaattcatcttcaaaagactgaaaaatatattttcctgactctattcctggatttaaaaggatatagataaaaacaagagacacataatctctccctggcacccaaagcacggaatagactgaaacccttgtttatgtatactggagcaggttcatcctttaatcagaagaaatgcaattcttgaattcaggccaaagccataaaatatcctagttcttcaaaaatgtgaacaatggtgaaccaacctaatttcagtatcatagtaaagagcccaaatatttagaaaccaacgtagtaaaaaagattaaaagggaattctctgtttcacagaattagtgtactgactcactttctatttttacattctcagttttcctacctgaaaacgggtttaaatttgccactttgctcttgtataatatatgacaccctgaaatctttgaaggaaagggaacaacataatagataacacaataaatatgataaaaacagaaacagaacacaatagataaatatgatagacactgatgatggtagtgctcatgccactatactatgttgaaattttccttctttaacatagaagttggtgacataaatccaacaattctcttttcctcacttgccaatgagtagtttaattatggtgaaaacggaaaggacgcatcagaccagagattagattgctgaaataacccacgagccctctaaaaaaagagcctaaattgcagaataacctctggagtcaggttcacttggcatctgttagtgcttaccaatacatgacaaatggttaagggttttataacatccatgatagagaacataggcaaatcttataaggcagatgaagtttttcaaattcatacaatcatttaatcttatagaggataatcccaccaggtgaaccaatgggatttgtgagtgtgggtcttctataacaaggacgagtgtcttatctgtaggaccaaatcaaaactctgaggagcctgtttgagtattgtacctgtgctgtcctggagtcagtcacttccttgtataggctgatatccaagtaatagccagactcgtttgtcaggaagaggcggatgggaattgcttttccagttggcgtcaggcgaatgttgattttcagttctgcctggaggacgcgcaatttccacaggcgacttccataccgcattaccatgctccgcacggattcctcaatctgacacagacacatcaccaagcacaaaacttaaatatcttctaactaagacctgtttcaggtctgctcatatttgagaaagaaggggtaaaaaaaaaaagaggttggtttgtggagatgcacaccttacaaaaagtggtcagatagtttctccccaaactattctttcttggaacaagtcagggacaatttcatgctggcctggcatttgagtggttttctctcgataataacacccaaatctctgcaactccttcccctttcccaattatattcatattctatatcaaagatctgcagtatctaaaattacaagccatgggatttaagaggaagccccaaataagaataaaatctctagttaaatagctattaagtagcatttatatgcatggtaactatgtttcactgcacttacaggactttaaatcaacacagcaattaccaccatgagctttttttcatacagttttattaaactttataatatatgtctcttggtaaattgcacaaattaaagaaaggcaatttgtaggtggtgctagaacattctctctaaacagagctctgaagcttggccactgctaagtccacctaggatttaataagatggggcagatgttcccacatttctctaagtttataccaaggcagcttaatgctcttagtttttaggggtaggacagttattttaactaaatggccttagacatgatttcttgttatttacatgctaaagcaaaactttttttccccaacatggctgcacagaacataatgcagctagaacatgctattcgaacttaatgtatccttaaatgaagtatctttctaaaatgcttcctcaacttcttagaaaatctcaagaatatcttacattccctttctcttgtggttctttagtagcatgtgccacccttgcagtttgtttctgcaccacaaaattttaagttagaatgaatttcagggagttaacctctctattatcatacttgcttgttaaccaagagatatttacccattcttttcttgagggaacaaaagccaacaatctttatgtacagaaaattggcagctatctatcattagaaaagcagagccagtgtatatgggtggttagaatgaaagcagaggctgatctgaaaaactcagagaaaaggtaagccaaatctaaaaaaaaatacagctgtacagtgtccatgccatgttttaagtttcccagcttattagtcccagaatgcttaggagaagttttgcttaaactagatgatgagatttgagtcaaatgagtagccctgtccttggcgttccttacaaactaaagcaacccatcattagcttggaatttttaagggaaaaaggtagaaaactacttctcagatctcagatactaagttcaagaagcaaaagtctaccaggcatgatgactcatgcctgtaatcccagcactttgggagtctgaggcaggaggatcgcttgaggccaggagttcaagactagcctgggcaacatagcaagaccctgtttctgtaagaaaaaaaagaaaaagaaaaaaaaaaaaagcagcagcagcagcaaaaattcatgcctacagctgatcttgaaaaagggagatactggttctcctatccaaattccacagtatcatgatagaaagagttagaaggggccaggcacggtggctcacacctgtaatcccagcactttgggaggctgaggcaggcagattacttgaggtcaggagttggagaccagcctgactaacatggtgaaaccccgtttctactaaaaatacaaaaattagccgggcgtggtggcacatgcctatagtccctgctactcggggaggctgaagcatgacagtctcttgaacctgggaggtggaggttgcaatgagctgagatggtgccactgcttcagcctgggcaacagagcaagactctgtctcaacaaaaaaaaaaagaaagaaagaaagcgttagagggagcagaaacagagagcagcctgtctttattacacttgggataaaaggtcaagtacaaaatcaccttgtttttcttccttaaattatatagaatgcatttcagaatagaacctcagggaagaaaatatacataatacatgagaaattccttatcagccaaattctctccctgtggaaaaacactaaagagagataggttagacactttgagaaggtgcattatctcactaaggccaccaggtgattaacatttagtgcacagaagcagtaatttagccaaaatgcttagtaacagtaaaattaataattccagatgagaaatagtagggaataatacaaaacaggaccactattatggcaaatataaaataggtaccaacaaaagaaaatgttttcacgtttttgtactgcttataagtgaccagcaagctaacaccaaaaccttcagttttgagaactgttttttcaatggctatatcaaatttttgacactgtcccagaaactcaatcttataaacattctataaactttacagattaagggctcaacagcctgaacaaggagtacctgtttccaagtccaagtgagataaatatgaatgaacttctgtgcttatgcttgctagtgctgggagagaagctaaggagaaatgtacctttgatgggtccatgataaccgtgggcacaaagttgaggaagatgtggttacagtcagtgcggacatttgtattgttaaaagcaacttccaactcatccatggcttccaggagtagccgctccccttcattttgcagatattcaaaagaagcttcctatacaggaagaaaataatcaacattaatgtagtttaaaagaggcaataaagaaatggctattataatcacttaagcagcagtatatcatgaatcataaggcacttggtgaagagattgtttatctttctccctagagtcagtccagtaaccacagggagcaggggcaggaaagggccagataaagagtccatgtcagcccttcctccttacttttagtgcatcattcccttccaagaggtagaaatactgggcatccccatagctgtaagttcaataggatgatatttcacatatgccaaacagagctatttagaaaggaaaagctgaagaaagggtacggctatgggatataataataatgaacacatcaggaagtgccttgctatatacagacactacccatacttctagacaggtgtacaatgggatcacctctttcctaacttatctccttatgctctaccatcacccaattcttcctgtgatttttctgtttgtatgctttttcttttcttgagtgttattatgcttctgctaccaagaaaaatcaaattaaagtggaaaaagagccttcattttttattttttttcagatgcactttctgctttgtaaaaaaaaaaaagcctttattatatgaaatatttacttttgtaaacattgaaatagaacaagaaccttgattcaaaaaatgaaaacctgatcttttttttatgttctctctcagcagaagcataatacctaattttgaatcatatctattattctgtcccttccctcagggataacatcccattaaagtacagcacccaccttggtgaccagatcagaatgcctgatgattgcacgaacaaagaacctgtagtctgtcacttctgtgcccacttccaccttggctgccccgagatacaggtgcatcttgtgattagcacatggaatggcagtgaggtcaaaatttctcatccggttcagctctaactggaaagccagagcaggctccagatgacgatagatacgatcctcctcaaactgagtacaagaatcagagaaaaaacagttcacaagaggcagttacaaaattatactatgaatgtgaatgtaaaagagatgcctgaaaatagaaacataagctatgatgtgctaatgagcaacaaaaatgagctacattcaaggctaatgctacagcttacataagattaggcactaaagtacctattatataggtactttataggatgatattcctaaactttcatcatttatgattttacaagtggtgatgatatacatgaaaaacaaacaaaaaatcctcaatttccttagaactcctacaacatttaatgtctttatataattcatttttatattaattacaggctgcttcacattaatatctacttcacatgccaatgttttgagcttacccaactaatctaaaaattttctcacttatgataagtacaaaggacataataaatactcaacaaagaaacatcatacaattttttaattaaagagatatttggctttggaacactatatccatagatatataattacttatatatgttttttaaaagttgtattagtatataactttactgtatttactgtatatgtactgtatgtttcagtgaaactaaagtatttttctggaatacatgtcaattgagtgaatggagagagagagtcaaatatataagccggtaacaggaagaaagcaacatggtctgaagttttgtattttaaaattgaaaaacaaattcacataaagtagagttgagtatcagtgaactatttgtagataacaagaatggtcctttaatatcacatcattaggatcattctacaggacaaggatgatttggaaaggtatcaccttcgttgagtagctcaatacatttggttgtttcccaaaccaaaccctttcagaaaggaatcggctttagttctaagacacacgtaaggcaacaggaagcacaagttcaataagagaaaaaagaatggcaagaagaacgtatggcaaagataagccgctcttgggcttttaagaaaaagtaatttttttttttaaataggaaagaaatcaatccttaccttatcccttgctcggaatgtaaaaaatttagggaattctctctgtattaaagaagggggaaaaatgtgtcagtagttcatagacatggctctttgagaacaaacagtatagaaacagttaagcatttagaagccagttttctagaaaaacatgcttcttacctaagcttagtccaggaaatatatatgaatgatcctccgcataaccatcactttgaccccatttccaaatttgagaatcaccacattataaacctaattttagtatctaccctctcccaggggaaaaaaaatgtatgaattttttaaatctcccaagtgaaaaaaatttttttgctaggtattgctcttggcacaacccagcaaataaaaccaatatacccttgtgccacagtcactgcaatagtagttaatggactgatttcccaagttactctttaagaaactcttaaaatataaactactcagacagtatagagtgctcagtccatgattttcacatttattctcaagtcaataatgtcaagggtttaaatgataacatttgaagatgaagaaaaatataagattctaccttggtcactaccactatatgtataggaaagaataaggttagaactagtgaacttgtaatcattaggtcttcctgcttttttgtagggcattatacaaaaaaaaacccaatttactagaaccttattaattaacaaagatgaattcaattagcagagttcattagtttctgaaatttaacttaccaatgccaaatacccctgtttctcggatgggaagctctactggcagtgctggaatcaaatcattactatttgcctctataggaggtttcattaggcatcttcttcattatgagtgcaatataatcaaacacttatcagtacaaggcagagagaccgggactagctgcctacacatcctcaatgagctttaggaaatgtgaaggaaacatggactgaaaatcttctggtggcaggtactctcatgtgttgtcctatctgatgctctcaacaacctctaggggtagatattgtgaccctcatcttgcagaagccttggctcaagtatatgctcagaatcacagagctggaagataaacttgggtctctctagtgccagagcccatgccctctgatctctcaagggcagagtattacctttctctttttattataatctaaattcctcatttagaggatttctctttgatgagacaaaaacacagaaattaagactttaaatttaaaaagcagaaagcaaacaaagcaaaactcatgctgtaaacctgtggttcttgaatttcctgaaaatttcttgaatacgttccataagtgttacacctcactctcaccttaactaaagcttgcacagttaataaatctttttatcttttccttggtattttaactgtaagactgcatttaaaaggttcctaggagctcatttaccaacctcagggaaatccttttttaaaagcctttttaaagtggattttacacaggactgaacttctcctcaagttttgttctaaataattctctgacaccgcccccacccgttatgagagtgaagcacataggactgacttcaaggttaagtaagatgcattcagctgaggtgtcgataaatatcatgctcatggttttatataacctagttttggttttattctagtgaggtacagctttcagagcattacctaaaaagtaacaaatgtcaaaaaaggaagaatgacaaaatctttccatggaactctctgaaagaaaagtcaaggaaagtgataatatgatattttacgcacacacttttctattccgccttaactattattagctaattaattaaaatgtttgtttaggatgccatttatttaattatgtacatttataggatcaaaaccatttcctttcaaaaacaaaacagtaataaaaaatgctttcttttccactaaaccaattaagaaaatttgtagtaactgaaaggcatataaagcagtttgaatggaaatgcctttaatacaaataatgaagaaactgactaattcttggcagaggtgggcaatgactaccaattagaaaaaccactttcattaaggttagctaagaaaagttgtcatgagatcatataaacaactttttttttttaaacttctgagtaaatttgtaactccccggtaaaatcctcaatttaagtattaaacattcagaacaagagatggcaagaacctctgtgcaatggaaaagtggaactactaagcaattcttcagtgacatggaagtctgaagactcttacaaaaagtaatctcttttggcactcaaaaaccacagaatcacagaaaacacagaaaagaagaaatctaaaagtctgatcctacagttttagtaaattcttttatcctatctcatcctcatactgccagtttttccactgaaagcattcatgcttattccatcatcaatgtatttgctttccaagtattctactagtgtcatgggcgaatatcataattgaatgtacacaaagaaaaaccctcttagtattctggtaccaaaaaacaaaagaatgcaacgtttcacaggaagaaattatgcccttgctgtgttctaatcagccaaccatcatcaagacaatcaaaataatttgcccaaattagccaatcaagacaccccgcaaatcagagaatgtgaaaacctgcaacaaaaaacatcatagctgattatgatactaataatcgtgttaaaaacctaatgagatgaagaaattgggagcttgctggtacaattctcttttacctcaacatgctgagaactaattatatagactgtaattaaaacaaaaatccaaaccaacccttctgaaaactaatagttggtccactaccaaacagaactatcttaaaaaaaaaaagaaaaaaagaactactaattatgataactgctcatatagtgagctcttccttcaaggtccaaataatccaaaacatttcattttaaagtgggaatcacacaatagtcataaaacaacaactctctctcgggagatatgtagatcttttttttaaatctcatgaaattttacaagaacaaaaggtaacattttattaacagatgtaaaactgtttgatttagaatcttatcatggttttaggacttaatgggggataagaagaagtcctgaaaatttgtattccgatgtccttagccaaactttgctgaaaaaaatatggaaagcttaaaaaaaaaaaagcataatattatatcccaattagacagcactttctgctaaatattttggaattccagacctaaaatgtgagtgaaactaagacagagtgagtcaataagttttaactaacagaaaactgtggagttgcagtttagatagctgcagaaattcaagaagcctcttttccattcaagactttgatcttttttcttttttttaacatcttgtccatttttttcttttattttttattttcagatgaacatcatgatctactttattttttcttaacaagtagaatatatttacaaaaagagacttgtttttcctcaaagtttctgtttaaatatcaaagttaggcagttattcaaattccattatgggcacttgatttaattagatggttatggaaacagagtcaactcccagcctccttaacactggtgaagactgctgtcacagaaataatctccatgcagtgtcaacggactagggtggcaacagacaccctaaaaatgttttaaagctgtgggcagctatctgggacaactgtggctaaactacgaagtattgtaaatgcttatagcaatcactgtcatccaaatcagtacctaacaatatacacagctctctagcaacctctactctggccctcatttgtcttattctggttctgaggcaatttgaaagaccaacaactatataacagcacagcttgctttattccactaaccaatgtgcttgaatcaaacttggtaaacttcctcctctccttgctccctcaagtgcaaattctctcttccattcaataatatagggattccacagcattggacaggggaggctgcatacatcacagtggattatcaagaagccagagagatcaagggattcatctctgacactcccagaaagcttcctctttttcacagtacactaactatggggcaagcacaatcagatgacatgacagaggctaaataagcatccttcatgaatgtcaagctaccatcagcaaaagaactcacagcagcaccacgacagtgacccccagatttgtacagtttctgccaacgcttcctggctagtgtagatcctggattgtataatagattctggatggagttcggtttaatagttgcccttgcaccttgcaaaatcacttatcatttttaaagggactaacataaaaacaccccaactcctctgccattcaattcttcagagcaaatgcagtcctcacttaaaccttaatgttctctatgctctaaagcagcttttcctacactcatgacaaatcaagtcacttgataatttaagtgatttcccacttgatgccactatatataggaatcagacaatgattgtcacggaagaccccctgctggcctcattttctagccgattttgcctatacatgtccctattaaacctagatccagaaatatcaggacagcagagagaaaaaaatgttttaaagctgttaagtatactcttaatactagggcatatttataactatacactatagattcagagataagaaagggtttttttatgtgttacatatatgagaaaatgtcagtgagaactaatcactttggtttgctaaaaattttagtgaacagttttagttgatcagtgtatttattatagaaaccagttagtgtgctatagatgtgaagattccatctaatccattagcaaaaaggaaaacaattttacaaatttagtgttattccctagaatatgctgttattctaaagtcggtgataaaaagcacagtaacatttaagaacctagcacaatactcttctaaaatccagggcctggctctggcatgtctaccttagttctgatcagcatctaccagccacagtgtttatccatgggctttcatattctatcccaaagtatcaattttattctctaagctcctgatttttcttcctaaagccctagggttctttttaagctcctcatacttctccactgactccgtttcctatctaaagttattgattgacatatatctacactctgcttgatttcctgacatcaataacacaggggagtcatgcagtccacaacatttcctaaagcatttcagaaaatcttagctctcttgtttctctatagactagaccaacaaggtgaactgtatgaaggaaaacaaaatgtcaagtcttgaaaacctaataaacaaaaaggtaataaaagcaatcacacataggtccttgagtttagaaagtcctttccagaatctcaagtgccatcttcattgttgcaaacaagcaaggcttaacaaccaaattatcttaattgctaaaaccaaaccaaacaggctgggcacagtggctcatgcctgtaatctcagcactttgggaggctgaggcgggcagatcacctgaggtcaggagttcgagaccagcctggctaacatggtgaacccctgtctctactaaaaatacaaaaatcagctgggtgtggtggcacatgcctgcaatcccagctacttgggaggctgaggcaggagaattgctgcaacccaggaggcggaggttgcagtgagctgagattgcgccactgcactccagcctgggcgactaagcaagacactctctcaaaaaaaaaaaaaagaaagaaaagaaaaaaaagacttcttaacatcctctagaatcttagttagctacattagaatcaatttttatgaaatattttgattataatcagtcattttgaaaacaacatattgattccaaactggatttctggccttactgttgtcactgtactgggtatgatcatacgggtataccatagtttggatgccaggctattaacttaattctcttttcaataaaaattttaatctcataaatattaacagttaattcagttaaatgggagaataagcaacagagtgtttaatttttacttatttcctgttcctacgattaacataagacaaaaaatagcaacttggctctatcaaggcattttaaataataaatcattgttctttagaattgagacttctcaataaagaatccaagaccacaaaatgcaactggctgtccttgattattgattcactataagcacagaagaaattactagttagcttgtttctaccttatttatctggataaatgcttatgttcattcttaactatttctcagagatatattgagaattcattatagggttaaaaaaaaaaaaagaagaaaacctttagctggaacacttgatataagaattaaaaaaaatttttttttaattaatagaggactgggtctcattatgttgcccaggctcatctcaaacttgtgggctcaagcaattttcctgactcagcctcccaaagtgctgggattacagagaactgaatatttattataataatttctaaaagaagaaggatcaaatatcagtccagcccttctaacatatattctggttaaataatcagtggcagacaaataaaacagtaagtaatctttcattattgttcattttacttacatgaaatctccgatccacctcatagttgacctgctttctgaaatcctttcaaataaaagagagaaaggaaggaaagacagcagaagttggcaattagtaacaaaatcaaaaagaaattgagtaaaagatgatgagttaaactaatgttttttaaaaatgaaacttacagaaaagtggttatttctctgcataaatcctattagtaagcataagattacaatcccatttttattaagttgtagcagcagcataagaaatattaaagaggtacaattcacatgtcagtaccttttgtgcaaccaggaaagtaaggcgccggatcccatggtcaaccagggtagctttctaggagcaaaaacatgtaaaacagaagatagatgagatttccattcattctaaattttatcccattcggcccttgtaaggctttggtggagttaaacatcctttttggatatccttatcttagcttagtaccttcaaacttgcaagtgaacaaatttcaatctggctcctaggactaagtcttacgaaataaattttatattgatttggacaaaactgaaagagaactttgtggaggagaaagggtgatatgaagtcaactaaattacctcagaactgatttacataaaggtaggccatgacacaatttctgcttatagaaatcatactgttgggcatgtattcaaatgtaaacattaatattgataaagatgctaaatgaaattaggtagagagaaaagaaggactttccataaaacataaaacacaggtcctaaactgtttagattgtagatgttacctaccatcagatacagcatccctagaattcagtctaacaaattgtaacctttcagttttgatacaacagtccccccttaccttacatgaaggcattttttaaaaactctctcttttaaaattgttaaaagcaatatttaataggcctttaaatttaggaactattcatatctccactaggcataggcgactagtatattagaagtcaacagaaggctgggagtggtggctcacgcctgtaatcccaacactttgtggggccaagatgggcagatcacttgaggccgggagtttgagaccagcctggccaacatggcaaaaccctgtctctactaaaaatagaaaaaaatgagccaagtgtggtggcacattcctgtaatcccagctacttgagagaatgaggcatgaaaatcgtttgaaccaaggaggcagaggttgccgagattgcatcactgtactccagcctgggtgacagaatgagactgtctcaaaaaaaaaaaaagaagtcaacagacaccagtagtttcaagacagccacttatacgagtcttgggcatctggacctaaagccttcctcttccctatactgttcacttgcttcaaaaggcagggacaaagaaacaaattaatgaattaagtaaaagacatgtgtttagaggtccccaacaaagaaggattataacagcaagcagaaaagcaaccccaccagttgaatgacctgagaaaacatatgaatagtacaaatagaaaagtaatgtggactttcacagcctacatccagactttagtttgaccacatttcttgctataactccaaccaagagatatgtttataggccagttcttaacattcatgatattatatattttttaaaatttaaattgtcttccccttataaggaagcacattcttgggttatttcttccaatttcttcaattctgcgatggcattgctgagtaataaaattaattttattaacagcataaacaaaagataactggaaaaattaattttctataagcaaataataaaataataaattatcaggccaaatataaataaattttggtttaactgcattaaaaaattatttgtactgccatcacacaccttgctgtaaataaccaagtattgacacaacaatatgaaaaaaatgtgtcgaaggaaaggaggggtttctcagtgtggccaggaacagaaatacttcttctgacatcaacaaagattccactacagtcaagtccttcaaagacaagcatcagtagctatgttctggcaagggaagaaaataactttaataatgccatgatttaaaatcaaaattgttattgcttttaaaattccacaagtggctgacaataacagcagagcaacaggattctgattacattgtaataatgcaggtctcacagcaagtccacagctattacccagcgattaggcatcagcacctggagaaactccatttacactgactgcttcaatctcctccacaagtcatttacaaatatatgatcctaatttctatgagagaaaaaaagacatgctgggactagaagattatttggacaatttggatcaacctatttgatagtttaatgtgtgccttaaaaaaaaaaactttttctaaactgctaggagcatgatcatgaagtgaaaaacaaaactagttgccactttatcttttgtttttttcttaaattgcttttctttccttttctttcatatatatatatatatatatacacatatattttaacaaggagatgaaaatgccaaatgtccctggataagcacagtacctgatgcagtaaatagcttctctatgcttagagtgtcagcacagtctacccttacctttctaaatagccttaggcaaagatattggatttctctgtgccttagtttccacacctagtcaaggaaaagggtaatttcttatttctcattaatgttacaaacatatgtagcgaatatgaagaaaatgcttttttttttttttttaattgagatggagtcttgttctgtcgccaggctggagtgcagtggtgcaatctcggctcacagcaacctccgcccccaggttcaagcgattctcttgccttagccacccgagtagctggcgctacaggcgcccgccaccacacctggctaatttttgtattttcagtagagacggggtttcaccatattggccaggctggtcttgaactcctgaccttgtgatctgcccgccttggcctcccaaagtgttgggattacaggcgtgagccactgcgcctggctgaaaatgtctttgtagatcaacatgcgttgataagtatgacacttagatttgagggcaacaagaagtgtcaagttgtggtcaaattatggaaaaatactcaaacatgggcaattagtgcctcaaaacctaggaagaaactttcacagattatttcatgaagcagcagcagcagcagccacatataatattaagactcttccaggccgggcgcagtggctcacgcttgtaatcccagcactttgggaggccgaggcaggcagatcacctgaggttgggagtttaagaccagcctgaccaacatgcagaaaccccatctctactaaaatacaaaaattagccgggtgtggtggcgcatgtctgtaatcccagctactcaggagtctgaggcaggagaatcacttgaacccaggaggcgggggttgctgtgagctgagatcgcaccattgcactccagcctgggcaacaagagtgaaactccatctcaaaaaaacaaaacaaaacaaaacaaaacaaaaaaactcttccagcaaagattaccttgatcactggctttaggttaattttatgtggtcactggccaagggcaagaaggaaggtaaatttctgtctacagaaaaagccctaggcatatcccctactttcacttctctggaagcaccttttcctcatactgaccactgcaatctcatagttagtttaagtgctacaacaccgtcatggaataagtactaagactcatagtcatcacaaatttaccattttttcccctagatatctaccattggcattacatgatgtgaatgccaatggtacgaactgtctacaccactgaattaaattttgaaaacatctactgagttctttctctgcaagaagtccatgggctaagtgctgtccactccaagagaacacatgggtcttgccatcaagggcagtttaagaggacactttgctatctatcacatatcataatgaaatataactgtagattattgttttaagcatgcctatcctgtcccctcaactagactataagcatcttcagggctaagaatgtattatttactaaagtacctagatctgtgccccctatacctggcatcaaatccttaagttctagtatttgctctatcatcttctagctggtgacctaggggtcttaatttctctgagctccagcttttgcccatgtgtacaactggaacaattcctgacttatctaaccccatggaatcgtggtaagatgcaaataaaaaatttaggtagaatttttttataaataaaaggcattattattgctaataaatgtatgctgaccaattaggaattcaaaggaggaacatacattttagttagggctactcagaagtcctcactgaagagatgaaatttgagacagttcttaagacaaacaagatttagaaagaaaggtgaaagaaaactttctaggaaagaggaagtcaaagaagtataataaatgaggcacattagacaatgaacacaggtcttttcacaaaatagcaaaggctacatgttagtctctcaataggctgatgatgttgaagctaaagttaaggaggtattctgaaggtcagagagaatcactgttaagtgggaaaataacatggtaagagcacatttgggacatttaattttgtggtgatgagcagaatggaaactctttggagggagaaagtgaaggaagataagtagatcacaagtaagcctgctgcagtgtctcaggtataagatagtaagggtttgaattagagatggcagtgggaattttaaaactggaaagaagaaaaagagaaagggtaaaaaagactgcaaagaaaaactaacagaccttggtgactgaccagatacaaataaatatgtacagattgtgggtagaggggtagaatgaaggaatgtcaaggaaaaagtcaatgacttttgaatgattgggagtaaaaggtatagtgagttgtgaggttttttgttttgttttatgaggggattggagagggacgagaagaggtgaagcaaaatgatggaaaatgtccatttagacgatggcgtttgatgtcaacaggagatatccaagtgacgtaaaattgaaaggaggatagatgtataactgatagtttcaaaggaggggaggggaagacacagaagggacctaaggggagtttaggcttagacatgtggaaagtcaccaaaggaaaatacttggtaggtgattcgaagttcaagactggagctctgggagagatttaggaagataacttcccttaaaaacattttaaatatttgaggtctattatctgttgacacacaaagatattcattatatattattaagtcactttgggattttatccctaaacgcagaactagccatagttctgagagttatgataaaagacatagccataaactagcaactgataaaaggatagctatgatacacagccagtagaaaggggacatcacgagcttccacccaatcaagaacttacattttgctgggtaaattctctgaacatagctgccagcctgtcatcctcaatatcacagtcagtcttgatagccacattgagaatgtgaattggttcatccctgggaacctgtaactcaagaacacaagtcaaagaaattatgaggctggccaatacagatgcagatagaagttataatatttggtagaatacctgaaaaagagatacaccccacaggatattttggtttgcccagcagtaggaatgagcaaattgaaaccactgcccaatagccacagagagattaaatcaggtaaagcatataaattttaaaagataaggcagcagaggcattagtaacaggtggcccaatctttacttggcatgaagctgaagatcactatgtctcaccttttttaccaataaaatgggggtgaaactatttgccacatctcttcacagaatgtgaaggaaaatgagtgatataagccatctggacatgttcccacataatatatttccttacaatttatcaaacaatggaagtatcaaatcatgaaaaaataacatcatagagaaagaataatttatttactgataaataaaaagaaatgatttaataaaaagacaaagttttcaacaaaatgcctactttttttctgtaatctaaagtcctccattctctgaggactatgattgcaccactatgcaaaaatataagccatggctgagtaagaattccagcaaccaaagcccaaatccttaaaacaacattcagagattcagaggcagctgcaatggacatagctgagcccactctatactatggactccaaaattaatatagtttttttaagttaggatttatattccacttgtttccagaaaatactttggtgaggcatacaaaattaaatactataaagtggggtaaaaggatgaattctttcctataatagttcaaagtcagaaagatagtatacagtagaagtcccatgtctgaggggaacaaagcagtctcccaaaagggacattataccttatcctcatcataaagagacgtgtgacctgcctcagggaatgtgggactctggggtggggagtcagagaagcagcccatcacttcatcaaagatcctaaaaaatacaagagaaacacccaccatgaaaactcaagtggcatgaaactaacactgccattggcagctgagtctaaaagaataatctatcttagcctgggctcaatagttaattgaacagaatcaccagtggctagaggtgacatgcaaaatttcaccaagtggcagaaattaggaggatggattgtttaaactttaataaaccatatatattttttcttttttagaaagaatgatctaaagcttttttgtttgttttgttttcctcatatgtaagatatgagcacttctgtcatcatcggtcttaaagtaacagaaagtgtctggaactggagtagtgacagaccaatgtaattacccctccccctagggtaatgcatcagtatacatcaagagatagatgctgaatgcatttaatcaaaagatgtattgtctcttgtggggctcactctagtgttatgtttaatttctcctgacatttcactcatcacagagcagacagcttcttctgttagctccacaggaaaagatggtttttgtttgtttctttttttctgaccaggcccatactacaagtagaggcttgtagaatctgaatgagaggtagaaatgcaaggatatatacctctccaacggcatatacagcaagggttacatctttttagctggctcatggctattcgggagacctttattcattttgcagaaagatgagaccccaaaacacagatgtccatggctccccttgtacagacatagttccacaatgtcttacctgacaaaatcttcaaaagtccgaaaagagaccattccgcccatccgctgacaaggtggagtgaatgagttgtccaacagtacatcgctgacactagctacatgggtcatgccatagtggttgaggttggaggagaaggacattctaaatggtaattcaatcacgttcattagacaaggagggtaggagcaaggactgggaaagtaacagtagggaaaaggaactaggagaaaactctgaagtagggtcaggttgcagagcagatttggtttttttacccactatggataaggttgttttgctggattcatgttaaccctttcttttgaatttccctaaataaactatattttcatcactccaaaatttcttcaaataaaaagctaagaactgttaggaatttccaggcagttttaacacaattacattataagatgtccaatgaatgaatagcacataggggttaaaaaccatcctgcatcttccccctccctaaagcattccctcctttaaaaggaagtaagcaagccaagtgagttgtaactatgcaatgcttaaggcattttgttttctaggaactgtaatagagtaagtattcacagatacataaagagataggtatatatatgtatgtaaaacaacaattgtaattaagtcacctggaatggtttagtaaataattatataaaacattagggtacagaaacaggtcacagtctataaaaggaactttactgaggaatttactttctcctttaatgggttggtaggcatagttattggggttacagttctccctttttgaaagagagctatttttcaaccccaaattgcacgtttttcttttcatagttaagcacttctataccaaaacaaaaaaatctccattgaaagcccttaataatttccagcaagatacaaaagggcagagcatgggtctcaaagtatgtgtaagcatgacaagcagctgctaaacggagatgcctgaagagaactgaactgatttgctcaatctaaaaacaatgaatctctatatttcttgatgtaccttaacagtatgtactgataaataatactgtaaagtgtttctgaatgctcaatcaggacagcctgttaggaaggaccaagctaaaggatgcctccaggacttgcctgacatgttaccagcatactgatctgaagcaagttcagggcaaggcaatggcacttgaatttggggaactgccccaaaaatctccttgaagtacaccacctgcggtgttgcagggggaagagagacgacaacgtggacttgatatctgggtacatattgtaccctatcgcaaatcataattacaaggcaatggaattctttgtaggatgggagtgctgctcacacagactatagagactgacactccaggtttttattcctttggcgagtgatgactatggaaaaggtacatcatcttttgacagtacttgggagtagaaggcaaagtgggagaggaaaccattgatacaatgaatgaaacaaacaaatgaaacacacatcaagcaagtcttacacatggtgctcactagaaactgggattcagagttgtattaccacagaagtgctatcatcctcctcttttctaggatcaccaaatatatttactaaaaaagcaagtttgtgaggcattgtatcttttctacttgcttggcattagacaggaaagataaaagggttccagaccacatttaaagggaactccctctgaagaagttaacaaactatgtttgtggcaaccatggggttaagtagctttttcactcaactgaaccccatgggaaatatcgactattcagtttcccctcactgctatgcttgtgaaccagggtggctaaaggcaggcaggaatgagccaagcccactcaccaagggaagactacaagaccaattaaaagcattccctttcctctccacatccaaattgggatctaaaagctatgattagtcttgattacttaatattttaaagggagagggacaaaataaatgtaaatctataaatagttccacgtgtagctgattatctgcaaagaccttgccatcaacttactattgcttttgcattttgtggattcaattccaatcagaattgttatcctctcaaacttgcattgtgttgccttgcttggttcaagagacaggagaaacccaaaatactaaaatatcacttatgttatattagcctggaaacctccacacagggttaaacacatcaaaacttaaatatacttttccaatgttaatcttattataggtctgaaataaaaactgactatcataacattttaacactttagaaaattaactaacaaactgataaaacatgagatcagctatttctggatctgcactcctctaaaaggagaagcaaattagagaaactaaaaattgtaaaaactgtgaataatttgccaggataggagtaaccttaagggtttctcctctgaaagccccaaactacacagagaacttagcaaaagaagatgttgctagcaaggccggacataaggcagataaaccccctatcatatacagctagatgggagcttctccatactgaggcttttcaagtagtgctttttgaacagctgaagaaaagctgaagccatgttttccaaacagaaagaataatttagtatgtccaaaggggagctcaggactccctagcagataacacattatcttgtcaagtgttgtggttttttttttcctggtttcactattctaagttacataaaggtgcttttaattggaaaagaaactaaacatacggtacctgtttagcgtagggatgttccctctgtaattaaacaaccacagttagttactgataagttagtgaaagccataataaaagaattgtcagagcagatatagaccagtcatgaggagctccagtttggcagctctggcattcagcagacataattaagtgctcattacccttcaacccccaggatacctccaaagaggcatgctcctaacctacctcaccacaccagctgttgatggaaagggtcaaaatgtatttaccatggattttaaaaatagctctattaccaaaaaaaaaaaaaaaaaaaaaaaaatttagagtagtggtaaaacacaggctgatgaaaattaatttaagctatatgatatggtatattaactcaagcttcaataagaaatataattcttcacaggattcttagagactcttctttcttgttcctattactgaaggtgtaataaggaggtccagggaagttgattccacagctcctcctactttaatcgcttatccaggatatgtgacagacctacaaattctccaccaaagaaaagtatccaggaatctgggttcccagctacctgctctaagtctttttaaccatactcttcctcccatgaaggagagcaggggggaaggtactgtattctaggagcttaaaagaactgaaaatcatgcaggaaagtaatgataaatgattctatgataagttgttaaaattaattaatactttgtaattaaatgagtttagggtcataatgattttaaaaattgctgttagcttaaaaactctaggcctctcataaataaaaccttatctaaatttgactaccacagaacttccttataaagaatgtgccaaatcatgaaagaaagaccacgataagaataggaaactacaaggcacatctcccacattctctttggcctttgccactaactccttttaaaagatttccccaactgaaaaataatcaaacaaataaaaacctttattttcaatgttaaatgggcaaagttatacttaccacctacaatttaggggcattgtaagggggctgatcggttgatatcttaaccttctaacattcttttatcagcatttaatcactgttggggttttctagcacacagaggacttaatgggcagaacatagtgggtggtgctgatgatatgtggaaaggaagatagagggaggaaaacgatgcactttccatggcagtagaaggagcagaatagactgagcaggccatataaataaaaagctgtgacatatcactgcacacaaactgtatacctcatgtgatttgtgagtagaaatgctctttgcatcaaacctgtatcacagagtgaattcataagacagcaagagcaacctctgagtgcagaaacctgaacctttgctgtttggattccttaagcctctcactcaggagagtgggttttatttttacaagagatccttagttataatgcacttgggcctcaacaatacagaaaaaataggcacaggttctagaacagagggaggtacagctgaacagaaaactaactgcagatgctaatgagaatagttttccttttacgatataaaggatgctaaagaaaggggccgcctgcacagtttcttagcatgaatctcagttcagagagaactctacaaccaaagaaacctcaggttccattcatccaggtttctagagtttagaaaccagtataatctctctcaactgttaacaaatttcctaatctaataaaataatctaactgcttctgtagctacattctaatccctttgggagtcttcacaggatgacggccatgttttcagtagaaaaaggcccgaactgaaaagaacaccaataacaacaaaaagccaggctttctccatcagcaactctcaagctcctacagagagccccctgctgctttgttataagaattatgcaccatctacacagtatgggtcaaaaagcaaaaactcccaacatctctaatttttaaaggaatggtcccaaatcaatcatgtaagtaggtttagagccagcttatccacttaggtagaataagaatctgtggggatgtaagggagataagcaaggaaggaaggaaggataaactgtctattaacagataaatatttggtcatgtccataatgatcatttacatgttttctttttttttttctttttctttttttaagaaatagagacaaggtcccactatgttgcccaggctagtcttgaactcctgagctcaagtgatcctcctatctcagcctcccaaagtgctaggattataggcatgagccagcaaacctggccactacaaatttttcatcctatacaagggctatatggtcaatttaagaatatgacaaatgtggcatatcgcacactactgtgatacaccagaaagctagattaacactctgtaccaaaaaaaaaaaaaagccacacacacaactaagggaagagattgtatacgagtcaaatattccatttatgtagctgaaaataaaatttgccacattccactgcatactcatcacgcaaaaatagtcaaattaggccgggcgcagtggctcatgcctataattccagcgctttgggagactgaggtgggtggatcacttgagcccaggagtttaagaccagcccaggcaacatctccaaaatccatctttacacacacacacacacacatacacacacacacgcacacaaatataaaagttagccaggtgtggtggcacacagtacacctgtaatcctagctactccgaaggttgaggtggaaggatcgcttgagccaggaggctgaggttgcagtgagccaagatcatgccactgtactccagcctgggtgacaaagtaagtctcaaaaaaaaaaaaaaaaaaaaagtaaaattgctcaatctttgataaggcaatcaagtatattttcaaatacataaatgggacataaattcacttcctatctgctgtttgggctattcaaaacacttattataatgaatcttcatttacaacatttgatgaatattagaaccactttctttctagtagattagctccattttacagatgtgataaccaaaaaaccaaagaggatgctttccaatgacattgttcaatatggtgtcataaaccacaatctagacttggcattttcttatctccgctctccaagttagcattccacatcagtatagattttagagaaagacaagagaaatcctgtgaattctgaggttcccggcactaagtcacctctgattttattgctctgcctgcccagaatggctggagagcttgcttcaatatgaatgcaaagtcagagttgccgcctgctagctgaaccctctttaatttaaagaacactgacttctctggcagccacaagttctgtgagcctttttaccatcccttccagctgaatttcatttggcttgattctagctggccttatataaatcttttatcatataaaaatgctcctgattcttttgcttcctaacttgaagaagaaaaaaaaaagagcccatatgaaaatgatggggatgcatgcaaacaagcagtggttacatcaagctgtgactgaaagccagtatagggcaactcttttgaaatcaggcagcaaagcagaatcagaagaggtcggctgaataacctactagcagccactaacagcagtaccataggagaaagagcaatttgactggctgtgaccagtggtggtctctttgcatgactatatttctgcaggaaaatccaaatcaagaactgtaaaacacatctgaaccacgtatttctactggcatctcccccaccacctccttgcagttcagatgccctgagtctactgcagagctttagtttacaataaaatgatcattacttcattcatttgcagcccctccaaagccccttctttgctctgctggaaggttttgctctttctgaaacaagtacatcaacagagctacagcatattactgttgcctgctatataattagctacgaacccacagcacaaaactacggggatttacaggtgtcctggattctgcttttccttcccccaggactcagctagtcttccttgacaagaagggaccttgggctaccctaatgatatattgagagttttaaactcaactctccaatcttacaagtctagagtgccaaaataacacagcagagactagaagctgagccacggatacaggaaagcactttggtaagcacttaaacctgctgagaatcttctcttctgccagatacttgcatcttatcagcagactaccctgaatgaaggaagcaagcactgtaagatttcatttatttatagctcattctggcttgctaactacaacaagtgctcccactgcagaaacaatgctacaagttggatgacttctgagtatctcagtactatccaaagaaaggtctaatctctgggtgttaaagattatcagaattcttgagaatggcagttggctaccaattagtcacatggaaggctcctgatttctaaccttccttatgaataaaaagtccagaggccgcccactgacagctgaacattgaggatggatgccaagcagcctaaactcagccatgaccaaaacacatgctatcaggggaaaacacagccgacctcttctggaggtaagacttgagaaaagggaagtatttgaattaaaacattataacacagaaggccaaattcacaagtagcaaacagcagagaaggtacagtggaatccgacttaactaaagcatggatttccatctatgaaataggtggaaataaacaccaataggtcctcacccattatatatgtacagaaacgtacaacaaagtacacctccatctcctgcatcaaatgtgatgcttcttatttgaatcacagagtaaaggttaaaaagattactcatgttcactagcgtatattaattataaaaatcatttggagttttaaattgtgtactcccagactgtcatattatattatacagagtcatatgtataggcacaatttatgggataatatactttacatatgtttgtataaatataactatattttaaaagatcaaatactagttgactgaagaatttgtttccagattatcctgaggcacttaatatgcccaaagcttagtgaaatcctgaaggtcaaatgagtcaatgaattgtgcaaaatacagacattcaggatgatgcttcagtgtaacaagctttcccatcaccagcaccagtgagtgatacttaagtttctgaataggaaaaaagacagacatatacaaaacttgggctctaaaccctaagactcactagggaaagaaggagaaaaaggaatattcaatgatatagtttgaactccagggttaattcatgtaaaactcactaaagggctgggctcacagaatcttcaatgagagaattaggttctagaagtctgcacaataataaaatgctcccttagtatagactagttgccctgaatattcctgcaccatgaaaacaacttgagatagtcacttctccttcaagaacacaagtcagttaaaaaatgacacattaaaaaaaaaaaatcccctcccctcaaaaagaatcacacagcctttaatgctaagaaggtaaaaaaggaaacacacacacacacacacacacacacacaccccatacacgttacatatacatacacacacatgtgtgtgtgtgtgtgtgtgtgtgtatatatatatatatatatgtttctaactatgcttaaatcagaaaaatctctttagctgctgttcaagtgaaggaaattttagaagtaaagggtaaatccagaccagaagcttgcctgagtgaagttctaataactggatcctctgctgaataagacctacagatgccaaataagttggaactacagtccccagaaaaaaaatttagaagtcttgggtagaagatcaaaaaggagataatatacctcgactgatgcacacctagcaagaaatgaaataggaagtcacacagattaggaataaactatttagtaatctgctttttaaaaaaattattggagtttttttttctaaaaatagtcgaattataccaaaaaacagagtaaccgcaacatgtcaaacaatgcaaagtcctatgatgaattaaaagaaaaacaaaaatgtaccaaatatgttactacaaagcaactgttcaagtgtgctaaaaacaggtgtcttctcccttttcagaggctcccctagtcatttgcaatatattttgcctacttctctaaaaatcaaaataggtcctaataagtaagatacaggtcttcaatcccaacagcaactaagggattttcctgaataaaaaaaaaaacaaaaacaaaaacaaaaaaaactctgctgccagtttgcagacagagtgccgtgtttcaccccaacctatggaggctaaatcacagtcaaaaacaaactgcgtgactgggaattatagtaagaggagttaaaaacaagggcaggtgcagtggctcacgctcgtaatcccagcactttgggaggccgaggcaggtagatcacctgagttagggtgttggagacagcctgaccaacacggagaaaccccgtctttactaaaaaatcaaaattagtggggtgtggtggtgtacgcctgtaatcccagctaatcgggaggctgaggcaggagaatcgcttgaacctggaaggcagaggttgtgttgagccaagatagcaccactgcactccagcctgggcaacaagagcaaactctatctcaaaaaaaaaaaaaaaaaaaaaaaagctgcaggaatggaattccatacacaatgagattgcagtcttgctttgatattacagcttactaagacacttctaacgatgtgctggacaaattttgtctacttcaaaaacacctagctaggaatgtgaagaccaagtgcaaggaaagaaaacacaaaaaattggttaaacaaaatactgtggctcatgcctgtaatcccagcactttgggaggccgaggtagacggatcacaaggtaatgagatcgagaccatcctggctaacacggtgaaaccccgtctctattaaaaatacaaaaaattagccgggcatcatggcaggcacctgtagtcccagctactcgggaggctgaggcaggataatcgcttgaacccaggaggcagagcttgcagtgagcccagatcgcgccactgcactccagcctgggcgacagagtgagactccatctcaaaaaaaaaaaaaaaaaacaaacaaaaaaaaaaacctgttttctcccccaataatttttggtctgtactaggtatggtggcacatgcctgtagtcccagctacttgagaggctgaagcaggagaattatttgagaccagcctgggaacatgacaagaccccatctctatgggaggggaaaaaaaaattggtttgttaacctcaattgggaaaaatataaaattctgttttatattgataagtaaaatatgtatgattcatataccttttctttattctcactgatttttaaagcatgcataaaatattgtagtgtaacatctataatatcaactgtgaataattcctgtaactactaagaataagcaacataagaataataatttttcctctctccacgggcactaccagtaacacaaaaaaaaaaaaaaaaaaagagggctcagtgtgactgtcctaattaatttttggtctaagttgaactgtctaatatagcagccattagccacatgcagctagggtagtacttgaaatacggctagtttatattgagatatgctgtaagtatagaatacgtgctaaatttcaaagatacagtatgaataaaagaaaaaatattaacaattgttattacatattgaaatggtattttggatataatgggttaaataagatgttatttgaattaattttatctgtttctttttacttttaaatgtggccaatagaaaattttaaatagcatgtagcttgtattatatttctatttgacagtactggtttagaagtagtaactgtcaattatagctgttcatcagagttcagaggagcttttcaaagtggtcacctggactctaatccaaaatgaatcgggtcttgaaagtcaggactccaatatgtgtattttcaaattacccctcagataattttgagaatcattaatctagaggttagtggacataactgagccttacaggacagagtggaacaaatattggtagccctctgtaacttctttctgtagaatgagaaacaatatgcttttcgcctgcttgatcaaaacaataacatacaaaaaaagtactggagttagaaaaagaagaaaagtacttggctcaaaactagctaaatctaaaagagcttagatttctgtttaagatgagcaggcctattgtataataaagactttggccattgtctctggttcctggaagagagactaaatccttataatttcccaagtaataggagtgtcattgttattttaagtcccttggatcacacctgagtttatgctaagagatgagatgactcaggaggggagctggtcactagaaagaccaactgtgtgattagaaggttgagggctttcagccagccagacctctgggaggggagattgagtttaatcacgtaggctatgatttaatcaagcatgcctacgtaatgaagccctgattttaaaatactctggacactgaaggtcaatggagcttcttggttggtgaacacatggatgtgctgagagggttgataaactctgattccacagggaacaaactgggaagctctgtgtttgagaccatcccacacttcaccctaagcgtctcgtgcttttggctgatcctgacaataaaactgtagtgcttgaactctgtgagttgttctgagggaattatcaaactgagaaaattgaggggaccctcaaatttgtagccagttggtcagaagtgcaagtggccaggggaccccacttatggccccatctgaagtagggacaatttggtggtggactgagcccttagcctgtggcatctgatctaacttcagatggctagtgtcagaattcaattgcagtacaccagctggtgtcataataaggttataaatccaaattttaacaaaaacatttgggggaaaaatatattttatatatataaaaaacatatttttcatatatattatatatataaaaaacacatttttcatatattataatatattatgtatataatcttataaaactaaattcaagtagtaaatctgcaataactgaacaagctatactctgaaactgaatacatcattttatgatcaaacctgatcatttgatcctaaacagaactttagatcaaaaaaaaaattaaagaaattttaacatttttctggttttcacaaagatgattttatttttcctttttattttgcaattatcttcaccttcacagttataccaataataatgatgacaataacaataataatccagcaggtttagaattacactgacaaccaagggagacttcagggagattacaggattactgttatgttcaagtctgatctttatctacaggcatgtccagatgttgggagggactggcatataagttttgtaaccacattgaactaaccaagattcatactcttgacatagaaaggtgaataagatttcttaacaaagcagtcaagaagaatttctctcatttttcagccaacattccctcaccaaactggacatatcctcaaataaaaaaaagtaggacagggagaacaattaagagagacaaggagagtgatgaggagggaaggaaatcagaagcagccctgcagcctgactacaaatcactgcccaaagggaagcaggaaaaagcaggaagaaaaggagaactgccctgagaattacaaagagcattaagtacagcgtgtagttctctacaattattcaaggaatgcaggaaaagaaagaagactgagtgctgtgcctatgtgtgccatgagtacttcgccgctcactgaaggacaaccattcgtttctagaaaatgagattctgaaatccatggaggcaaaaatgtaccgagagatgcttgctaaatcaaggatatatgcttttctctgccagccataaggtatttttgaggtagagaagtgaaaggatattctgagacaaagaagagaggtactttttctgaagatgcctctgctcatctgccgacctctgctggatcaacagtggcatccagtggccaaaagtctcagcacagacttctttgtctccagaaagggtttctattgctttgggtgaagtggcaatttagaacaaaaccatttctggtgtctataactaaggttcccaaaagacacagtactttgtaataccaagtgaagaaccaaaggccataaagaagaaatggagaggggcaggttaagattggctgtggtatttatatttcctgtggtattactaaaaagaatgaaagtacaggaggggatgaacctatgtgtgggtggaattcctagattttcattgccttagaatactttttaaaagatagtctataagataaagtattttcattttaaaacaaaagcaattctgaaacaaaaacgtccatatgtacattttattttttaaaagacaggaagggacaaataatgtaattatcatggcttaattcagtaatttatttgagattaagaagtttggttctgcaatgtaatttttaaaaactgattgaatttcaactgctaaattcaggtggtctgttttagggagataatgaaactggctcagatataacctcaacccatagcaaacatatagaaaagaaaagcattccacccaaagtatttttttggtctaattgctgatttaaattgttaaaaagagtgatttttctggcaaagttctagcaagtaaaatgctagtaaattctttctaattttttaaaaaagaaagaaactatttcctcagtgacataatacaagcaagaatgaatggagtaatcctaaactttcatcttacttagaccataatttttctctttagatcaaagaagtgggcaccaaaaggctcttctcttttggttcatattgttcattttttgccctacatttctaactaaaaaaacatggaattgtcatacacattactccccttgattctcatggtatacctctggctggctcgggtgcacataccacctcaaactcacctgtttggatgagatgtgggcagcatgaactggaattccaccacacaggtgttgtccttaagctggcggtgttgtacgctgttaagttcataggcaatataagcccttcgaacatacacctggttcaaaagaaaccctcagtaaataaatttcaaaaacagaaattaagaaaatagcccagaaaaagagtcttgaaacgaggtatctgaggcagaaggtgctctgtggggagagaagtcccaaggccctatgtatacgtacatatattgctttaattaataaagctggagtcttaatactataaccatgactactaatgaaaacaaaactaggctgcctctgctggacacctatgtgcactgtaaaccttcttccacactaacctaaaccctggagaaggtttaatctttagcaaaagacagcatatagaactacaactattaatctattaagcatgatcatttcaacagaagattaagcagtgagaaaaatgagaggtgctgattttgagccacttacagagtgaaaatagaagacacaagcaatcacagtacagttcaactcttttactatctcatgtctttgtcttgcgtcctccccgacttccccacccgctcaaaatcagttttcagcaaactctgatcaaaagcagtaaggcataagcagtaagacataatttgacatataatatctcaaatacttgaacttgactcaagagttaaaggaacagcaatgaaataaaataaaaataaatataaattaaaaaaagaaacagcaataggctacatctctgcaaaaactgtcagtccaacctcacacatttcacagcaaatttgccatgcacataaaatgctacctgagattctatggcacgggaagtatataaggaagcttctcattaaatgacataaaaacactacaaaacacttaaatgttttaaaacttttggcatttactgagtaggataatttacactctaccacagagtacaaataaaaagtaacacaaaagagctggcaacagactaccgtgatgttacattacataaaatcatctaaaacactctttttccccatcttcaaaaaacaactatttggcaactttacagtggtattcagggcctgcaatttttgtgcttaatgaggtagtgtgctgtagcggaaacagaagtctttggagtcagattagcctgagttcaaatgcaaactcttccacttattatctatgtgattttggacaaatcacttaacctctcagagtctcactttcttcttacttcctaaagtaactgtaggattaaatgagaaagataaaatacctaaaacacagttcattaaatgctattactttctttcctttgaggaagtatttcataagagctgcttgacaatccaaacataactaaaatcaattttaatttggcccaaatcacacaatggtaagatgacacatgctctgatcagccatatattttcgctttttgtgttacaaggaatcctaattcattatgaaatgggagaattcaaatacctggaaaatagaaactactgaaaaatgctggcagctattttcctgtgattggaacctagaagctggtgatgagttcagatgaaacacttgagtaaagtatctgagtaagcacatactgtttcagaggaaaagagactaactacccttaagaaccaaccttaaggccagagaactagaactgacatggcagccaaatagacagaagaaaccagctagaaacaaaggaaaaggtcatgtcccattaccataaatacttacctccagagctgccatcctcactacttggttgctgtgatagaagaagtttggtaggacatcaaaaatagatgtttctgataggatgagtttctagaagatacaaagacaggcttaagccttacatcaaaaggagaacaatttcaatggacactatttggcatttgaagcatttagtgaaacctaagaattttgtctctgaatgccataatctctctgtgcctcagcttcctgagctacaaaatggagaaaataaaatacctatcctcatagggctgttgtattatatgagtaaatacatgtaaaattcttggaatactgaattaacaatgcattatttgtatgctaatataagtgtttatgactgttattcttttctgacatttatctgaactctctaaatattgtcttcaccaggcatggtggctcacgcctataatcccagcactttaggaggccaaggcgggcagatcacttgaggtcaggagttcgagaccagcctggccaacatggcgaaaccctgtctctgttaaaaatacaaaaattagccaggcgtggtagtgagtgcctgtaatcccagctactctggaggccaaggcacaagaatcgcttgaactcaggaggtggaggctgcagtgagccgagattatgccactgcactccagcctgggcaacagagtgagactctgtctcagaaaaattaaataaaataaatattgtctcaatactccactatggtaaaccctagatttgaactccagttgaaaccctagatttcagctattaaccaaataagaaaaaacatccttttttcccctctagattccccaggaagaaatgttacagaaagtctaaagattcccctgggccagatataacaatggtatccttgtttccaggtagaaaaatataaagtcattcctgagaagataacatttaaaaaataattgcggtggtccttctgattagtagtaaaattagacaataatctcttaaaaacgggcttcttataaagcttaataataagcattaacataaaattaaaattaaatgatacttaaatagctttgtctccagaagagtaacaactacctatgtatacatctgattcaaatatcataaatcatcagagaaatgtgtgtgtgtatatatatatatatatcagaaatcaaccagccttgtcatttaattctggcctagaatactttctaggtaaagtacaaagataaagacttcaataggacacttctatcaaggcaggcctatttgatttttaagctaaaccacaattctaacagcatttgtatgaaaaaaatattcataagtataaatcattttagaaagtcaagatatgaaactccattatatggaaaatcaaaattaattaattaagtgactaattacttaaactatgcttgagaataaaggaggtaagagtccagataggcaggaaagggttatatatatatatatatatatatacctgcaggttctcaatgcaaaattgatgtccatacatgtcaatagctgataggaagatagactctacttggttatggcgaagctcatatgatggcaaatgggaggcaataagaacctagagtgagaacaaaataggaggcacacattcctcggagtgattattctagactcctattaggcagctctgatacaaaagcaataaatataaatctgtaagtgcaggcatcacagataaaacagagaccaagtaaaacaacttctaggtcctgtaacataaagccagtgccaccaaatactgaatctcagttgactctcaccatgatttgcattgtggccaatttcccatggtgggtagggggaagggagagaaaacagcttcgatcaagttccatcagtgtatgtgatttaccattgcaaagctgctggtcctagggactgcatgactagctgttaattgggaatcaggtctggcagggagcagctgtgggaaaggtagatgcagcagagctagccttttacaactctgaagtagaaagaaagactagggaaagctgctttgacagccccaggtactcggcaccaaggagaacgcgtcaggaagtaacaccagagtgtgtgaggggcagagagagtgaaagcagtgtcacaaacaaacaaacagtgacacggtaggatctgaataccctcagcaggtcactgagaggttcaatagctttgagtagttcagtgacatggatacaattgtagagaaagcagaaggtcactgaacagcttcaaatgctgcttccttgtcaatgcccatgcactgaaacacaaagggagtgccaactcttggcttccctgctgaaaccttttggaatggaaatgaagactgcagggtgaaactaactggacttctctggggttgttctgattgctgccgcctaagattcatttcattatctttctgctttccacacttgattatttcctgtacacttggaagttttcatctgcttctaagctccctttgggaagtaagaaatactgagtctattttcttccctgagtgtcctttcctccacctgaccctggtttactatcacagggctactagggagggaagggaatgataccaggattttttaatggggaaagggcttctattttaaagagacgcagcactaatcttttcctttctctttaaaaaaacataccacatgaaaacatttgttctgaggaaaacgtgacacatatatagaaaataacatgttctttgtaaagtgattaagcaaaagttcattgtgtctaggactgcctgatctatgaaagccatccctcctttaagaaaaccaacaaatgtccttacctggcgtgctcgaagtgctactttggcattggtggtcttactgagttgagttagctctgtgagaatattcagcagctcatcagtgagagtagggtcccggccacacaactgatcctaattgttaatgtaaaaaagaacatagatagtcatattaaaaagaacaggtggataggattttaaaatagagaaaaggaatgaaaacaaagtaaacccagctggattaataagaaaatgcaaacttcctattatttttaccctaaacaatgtggtaaagaagatcccagaggaagtttggctaaggagaggcagcccaaatccctcattcaaaattcctaatgtatttccttataaatcaacactatacttttaacacgcagaaggaatcattagagaccactaaaaggggccaaggggattctgagtaagaaataatagatatgtctcaaagttttaagagaaagttttaaacaacagggactaaaggccttcctgtttcccctcccacttttggaaagaaggtagatataaggcaaaaagaaccaccccagtggttttcatctcataaaccaaattttcagcaacccaggaggatgcaaaacagaaacacaagaataaattatttatttataaacacacactaactaaaacaccatctcatatgctggcaattctgcatcccaaatcatttctcttcttcctgtaccaagaatcattccatgatacttaaacatgtgaatccttagctgaattagaggaaaaaaacaggctcctactatagaatccatggtttattcagtattgggtccttcctcttctaagaagtaaaaaatgttaagaaaataatctcaatcatattctgagagaaatatccttactggagtccagtggaatatcagtttattccctaaattcatccattatccatgcaatttccatctaagctgaaaaaaatgtaaatgcagtttttataaatgtctgtcctttttgaactttacagagctactggtagtagtaattattaacaccacaccatataaaatatatccatttagatatcactacctctacttggagttttaaataattgccttggctgggcagggtggctcacacctgtaaccccagcattttgggaggtcaagacaggaggactgcttgagcccaggagttcaagaccagcctaggcaacatggtgagaccccatctctaaaaataaaaaataaaaataaataaaacaaaaaatttttaggccgggcgctgtggctcacgcctgtaatctcagcactttgggaggccgaggcgtgcggatcacgaggtcgagaccatcctggctaacacggtgaaaccccgtctctactaaaaatacaaaaaattagccgggcgtggtggcgggcgcctgtagtcccagctactcaggaggctgaggcaggagaatggcgtgaacccgggaggtggaccttgcagtgagccgagatcgtgccactgcactccagcctgggcaacagagcgagactctgtctcaaaaaaaaaaaaaaaaaaaattttttttaaagaattgcctttgtattttaataaatatttattctccccctactaccaatgggacatgaaagaagacccaaagggcctgcttgttgctgcatgttaatctccccactttgattatcagcccttttcttgaagaatttctatttcatacttaaccttccccatctcagggatactctttatagacctttatcacagaagtataaataaatgcagtataaataaaagacatgctttttccaaaacccctaccttccacatcacaaggtaaatacttttgaaatactcaatgccattatgctgggaaggtttctcaaacccttttttttttttttttttttttgagaaaatgatataatgagattctggttccctaatccaccaatcagaggtctgctctgactgtccagagtcataaaacatatgatgggagttataattaaggaagtgcaagtactgttttcacccatttcacccagataattcactcatctgagtgagaaaaataaaagctgctattaaagtgaagataaacccagaggttctattgaacaggtagcacagattagagaatctgttctacctatcctaggcataaaagcaaacaggagaaaggaaatgcaagtaagtctcaccttttgctgagaactaatgagcaaaacagaatttcaaaggaatatgtaaaactaccagaaacaggaccatagaaagacagaaggaaagaattgacagataacagtaggtagggaaaccaacataattttttcctacctaagtccctttcctaatgttcttaatagagcaaacatactcctttccgaagtacttactaaaagcattggaatgacccaccaaaatgcctaaaaacataagaagtctactgggtaatgccacaactcgactcctctgtacaaagccagactaaagtctcaacattaaaaacaaaagccaacatgacaaaataagagcactagggccaggcgcggtggctcacgcctgtaatcccagcactttgggaggccgaggagggcggatcacgaggtcaggagatcgagaccatcctggagaacacggttgaaacccgtctctactaaaaatacaaaaaaattagccgggcgtggtggcgggtgcctgtagtcccaactactcgggaggctgaggcaggagaatggtgtgaacccgggaggcagagcttgcagtgagccgagatccggccactgcactccagcctgggcaacagagcgagactccgtctcaaaaaaaaaaaaaagcacactaatcacctccgcaacctgtatcagatttgatatagaatgcattccctttaaaagaaatataggtttacctttacagatgaaactaaaatttttaaaaatggagttatcctcttgcatagttacagatcatgttttgttctgttttgttttgtttttaagacggagtctctctctgttccgcaggctggagtgcagtggcgcaatcttggctcactgcaagctccgcctccggggttcacgccattctcctgcctcagcctcccgagtacctgggactacaggcgcccgccaccatgcccggctaattttttgtatttttagtagagatggggtttcaccgtgttaaccaggatggtatcgatctcctgaccttgtgatccacccgcctcggcctcccaaagtgctgggattacaggtgtgagccactgcgcctggcagttacagatcatgctctaacttaaaagacaaaacaaagcaaaacacgtaaaagcacttttttttaaaaaccacttttttattttatctttccactatgagagaaaggcagtaaaaaagggcttcaggagaaaacaacagtatgtgtaagaaaagcgaactatggagattagaaaaaataaatgtgggccaggcgtggtggctcacgcctgtaatcccagcactttgggaggccgaggtgggcggattacctgaggtcagttcgagaccagcctgaccaacatgatgaaaccccatctctactaaatacaaaaaaattagctgggcgtggtggcgcatgcctgtaatcccagctacttgggaggctgaggccagagaattgcccaggaggtggaggttgcagtgagctgagattgcgtcattgcactacagcctgggcaacaagagtgaaattccgtctcaaaataaaataaaataaaataaaattaaaataaataaataaggccgggtgcggtggctcacacctgtaatcccagcattttgggaggccaaggtaggtggatcacctgaggtcaggcgttcgagaccagcctgaccaacatggagaaaccccgtctctactaaaaatacaaaattaactgggtgcagtggtgcatgcctgttatcccagctactcaggaggctgaggcaggagaatcgcttgaacccaggaggcagaggttgtggtgagccaagatcgcgccattgcactccagcctgggcaataagagcgaaactccatctcaaaaaataaataaataaataaataaatagataaataaataaataaatgtgaagtaattatcaaacagtatgaattaaccactattttcgttagtctattctgacttggaagttttccattcaaatattttctccactgtcatcattaatacttagaaaaaaattggcaacagaaaattatgtatagaataacttcctcaaccctgtcttgtccctgacctagacacagcattcaggttctgcaagaaaacatcagggtttttcagaaccacccatcttaagatgccaactaacatccaacaggaagtttattaccctctgtcctagagacaggcttcttttgggcaactggacaaacaaacatcaccatctaatcctggtgaacattttgtaaggatacctttagatggtgtctaggtcagcagatgtgtttagtcaacataaaaaggtttgtttaaagagccaacctgctgattttgggattacaggtcacttgcaaaaatctggcatcccaatccaccaaccaaaggtctgttccaactgtccagagtcataaaacgaagtgaaaattattattcagccatactggtacaaaacagttatttcttgcttttacttttgacctagatggtagctaactataggaaatagttcgaatttgcagaaatacaacaaacatgataaaacgttaaacccatagccaaggctgggcacagtggctcatgcctgtagtcccagcattttgggaggccaagatgggaggccgagaccgtttgagcacagaagtttgacagcagcccaggcaacacagtgagaccacatctttaatttaaaaaaaaaaaaaaaaagcatagccaaagttacacagttgactgacagaagaaaccaacatagtccaacttgatcttagaaggcaattcaaaacgaaaagaatgtgaccttatgtgtaatgccctcaagacattaactattatttagccgggtaggcactaaacccaggatcagcaatgaactggtagcttcttctagtcatatctgcactttttgatatcccaaaaaatgtcatagggtaagtttaacaattgttaatatcacccttattcagtgaatgtggaatcactgagaaagacttttcttctttatttacatattggacaaaattatttgcagtcaggttaagtggaggaaggaaaggtgctgatcagcatcataaattctccccatctaaaccaaatcaggggttcataggcatggcattactcatacagaagcatggtttatagcatgttcatgtggaccgtatcaaaaataagttacaagtagtgaggggaagactacttaccatcaaggtggctagaagatatgtacattgccatctagacagctatgaagatgttgatactttgtatttgtaccaattagcttaatctggctaaagattaaagagttccttaaatatctctaagcaaacataaacaatgttctgagttctaagctttttcctataaagttaaatttaagaaataagaagagctttcaaaaaataaatgtactattggtcttccagactttgtgttaaattgtgttacaatgtccctttaaatggaggaaacctgataggactttagccttttacctgatactttgctttccagacagagtgaaagattaccagaaatctgcttgagagtccatgaggcaagttaccactgggcaggttatgctaacacctggagaggatgaaggtacctctttactagagcaacgcatatcccatgacattgactcacggaagcctgagtttcttgatacctccctccctgtaggttcaaaagccccagaaatcatcatctagctcagcaaagcatactatcaacattcctacttctagaaagcagagaatggaatactgggcacataaccatcaatcaggaagccaagatatgcaaagaaaggggaaccagcagagaacacaagctgggggagtcaaagtgctaccatgtgcaggtgacatctgtaaaagatactaagatccgaggaaagaataatccaaacaaccaaaatggctcttaccagctactaccattaatgcagatgtgggagaggaggagggagaggaagaaggaagggggagcagctaagcgttgtcaaagaggaaaagaggaagacatgtctggcattcagtaacatcagatcagaaaagagcaccgtcttgagcttttacccatgttccataagtcactgctagctggccctgagcttgatcatatcattaacttcttgatttccaaatctctaagatgaaatgaaaacaactgatatttgaaaagaaattaatgacatgaaagcttagagatcctcttatgtttactgggtctcattttgtttttgttttttttttaaagaaaaatgtaatgacaccaaaataaagaaagggacaaatctggcttcctggttcacatgttcaaccgtccttatcctcctcctcctcctcctcctcttcccatcccccttgtcctcctcctcctccatcctattcacccaaactcaaactctgaaacagctcttttccctaaagagctcagcctgttggaaagaaagtctgggtactatccatgcaggtaagaagtaatcaggatgacaaggtgggagaaaaaaagaacagcgtggaaagtcagagtcccattggcttctgcctgtcctgactggcaaaagcagaaagcaaagcctcaaaccagttctctgacagggcccaacgcctctgcagcaccccccgcgtaattacacacttgagtgactggactctgaagaaaattgaaggcctgagctccgaacagctgccattttctctctccatcacaccagcgtgattacttgagaaatgaacagccctggctcaaagctactccagaattctcagaggaaatatggctccgtgttccaataatgagattcttaaggcaagcgttacttacaatcactccgcaaaaggagcgagctgagcccctatatcttacaaattagaatttaagaaacccagcgacagtcttggacaatcattactcttccgctgctccaaggattctaggctttggtctatttttagtgcagaaaactgttaagttcttaaaaacgtaatcacaataaaaagaaaaactcaccataattagcttcctataaaggcaaattccaccccattctaggtccaaactgacagattctcctaccctcctcatcattacccttttctgacagaaagtcttggctttatccaaatgagatttaacaatcctttcattaaattaaaaaaaacatctaaatagtctttcttccttcttttgactgacaaaaaaaattagcaagctgccatagattgtatcatttcttagctgaaacctgtcacttgggggaagttgaagtattacattgtactaacatatatatttttccctctcaactgcatctttctcgtttccctaccatctagctattctagggtagcaaaggcaatgaactctccctataattacatattttttaaagtggctattctaaaaaatgtgatacgctttagagttaaccagctaggcatataactgaatgagtggcactcttgttaatcagaggtgtatggtagatagtttcccttcattctgaagaaataaaaaatagcatgaagatgtatgtttttttcctccatgaaaaaatgatgtaattaacttaccaagaatcccaattccacaaagagacaaaaagaaaactctaggagtgaaaaggcactacagtccccaaaaagacaggcatgcagcagcaaggcaaatgctcaggaccatggggtgagggactctaggagtagtcctactgtactaattcctacaactaactcaaccagaatgagctaggagtgaaggacttgcaagtcatctttaaaaatccttcagcccacaaaaattccacccactggctgaatgcacattagctctcatcaaacttaccaggctcactccctattcctacttcctactaattcttattttactaagttatagggaaaaaaatcatacatttactaccaatacaataatccgagcttagattttcaatgtaaataaaaagggaccaatgaagatgcagaatacatttaaatttctctggtcagagagggggagtgctggatttctatttattttttttcaagtttgacatgagagccattgcttgtatctatggaacaagagttaaaattagaatatattggctaaataagatgaaattttaaagctgctgtcatgatgaccacaggaatggtgaagcacgaggcatttctaaacagagttaggaggtataagttcctgtgaatgagtatatgcataatggccagaagagtcattttctcactaaagcaggttccttcagaccaaggacaaaggtagacgtgagaaactgttaatccacagctcaagccccattcatcccataattataaaaggcagtagttttttttctctggccatagccatcaaaaggaaaaaaatactttttgcatatcattgacggtctttacaagttctgaaaaatggtactcacaataagcattgtgaccagaagattcttcttggtgacttgagcgtgagagaagatgtagttcagtacagtgttcatgtcacttttattctcttctcggagggcgaatacacatttgtcatagtgacctgcacaccatgaaaagaactggttctcacccatgtataaatgttcacatttacatgctatttgttttgtactgtctataatttatgagacgagcagtgagaagaaacatcataaggattttcttggatggatttgtacagaaactggcaatgtgatttagtaaaaggaacactggactaggagtcaggcaatttggatataagatctgggttcaaggcctagttctattagcaatttactgtgtgctcctgggaaaatcattttacctctctgggcctcaatttcattaaattttttaaaaattggggaggtgggtgtaccttaaagactgaaagattgggaataactcaaaccccagtcttactctaaactctctcatgatttctttagacgagaaatttctgtttaaaaagaaatgtaaatatcattaaacttgatgatctttaaggtctcccccagagcttgagattctgattccatgtttgacttgcagaaaatagttgaccctaatcagtaggaacagttttagctcaaaaaataaaaccacaccaaacttagcaatatccatgagaagtgtgactgctacccctggaatcaacattttcttctgttagtccttgaaacagctaagcaatgcctaggaacgccaaatccaacccaaggtatagatcaaggagaaccttgcattaagtcaaaaggtctgtagggagactaaagttatgcatattttcacttgccttccctaaggccaccaggggcaggttagttctgagtaggaaagctatgttttacaacagaagcataagcctctggtacactgtagtgatatctgccatgggatataagtaatattcagttctttagaaaacagcttacctcagaattaaatttccaagtaaagaggaattagtgtttgaatattctcaagggtcagaattttatgaaatcatgaaaacagtaaaggattatcacctcagttcagattccacgttaagttacaaaccagaacagtgacgttcaaactgcattatcatggtttcctagaacactgagtacactggaccagtgtaaccaggcttttaattattctaaatattagagattgacataagcaatttttttccaaataaaattatatttgaaaaacaatggactacaatatcgagagagctgccaatttcataaaagacacatttagaccaaaagggaagctgtttaaaaattagctgttctgcattaatatttttctctaccaagacttagctttgaagtgacaacacaaataaactttggcaataggaccaggggaaataaaaagaacacatttacccggggtgaggggagacattaacagaaagaaagcaatgatactttcttgttttttttttttttactttgaagatcctgcataccaagacactcttttttaaaaacacttaattggctgggtgcggtggctcacccttgtaatcccagcactttgggcagccaaggcgggtggatcacttgaggtcagacatttgagaccaggctggccaacagggtgaaaccccatctctactaaaaatacaaaaattagccaggcatggtggtacacacctataatcccagctacacagcaggctgaggcagaagaattgcttgaacccaggaggcagaagttgcagtgagcagagattgcaccactgcactccagcttgggtgtcagagtgagacttcatctcaacaaaaaaagaacacacaccaaacaaaaaacaaaacaaaacagtttaattatgaaatatatatacagaagaatatatagaatatatggtatcagttgaaataaacacccatgtgttattttaaagccattacattttaatagaacatctctagtatctttgaagacccctgcgtacccctcctcagaaacaactactaagctgaattttatgttaattattcttttgtttttcttaacttttatcaccaatgtatgtatagcttaattttcctggtttttgaacctgaaaaaaatggaatcactgtaccatttcttttccttaacattgtatttttgagattcatccttttgttcagtgtatgccttggtgcatccattttcactgctgcatagtaatccatggtaggaatataccagacttcaatgatccactctacctatgtatatttagattgtttcttgtcttttttaagattatgaacagtgctgtcacaaatactcctgtatatgtatcctagtaaacatgtgtaatagtttctctaaagtatattttctaggagtaaaattactaggttaaagaatacaaataagttcaactttattaggtactgaccaactgttaccaaagtggtatataccaatttgtacttccatgtacagaagcaatgaagatgatgatgtgacttttaaatttttgccactctcattgtggttttggtttatatgcctctaattacaaatgggattgagcatctttgtgtaagtttataaattatttgtacttcttcttctgtaaaatatctttctatatcttttgcccatttctctattaggatgtctttaacttgatgattcataccaattctctagatacttctaattattttttaggtatatattttgtaaatatcttctcacactttgtagcttatattttcagtctctttttttggagactgtgtcctgctctgtcaacggggctggagtgcagtgatgcaatcacagctcactacagcctcgacctccccaggctcaggcaatcctccaacctgagcctcccaagaagctaggactacaggcacataacactacacctggctaatttttgtatttttttagagacggggtcttgctatgttgcccaggctggtctcgaactcctgggctcaagcaatctgccggccttggcctccgaaagtgctaggattacaggcttttcagactccttatgacgtattttgatgaacagaagttcttgagtggagtttaagtaatcaatcttttcttttgtagtttgtacttgctgtgtcttatacaacaaaatcttcctatcctgaggttataacgatattctcctaaccatttaacagcttcacctctttagtacatatttaagtctttatcgggaattgatttttgtgtataggcataagatagggattccatttctttctttcctctttttttttttttaaatgaataacccattgtgctggtatcatttattgaaaaaaaaaaaaatctatcctttccccatgatctacaatgcctcctctatcataaaataagttttcatatatggctggatctgtttctgggtcattaagttccactgatctataaatctatctctacacctatctcacaatttcttaattaatatggctttatattaaatcttgatatctgattaggcaaatcttttcaccttgtatttctttggaagtatcttggttattgtgagacttgtcttttatggaaattttataattagcattacaaatacactaacagaatttttattgaaatgtcaatctacagatgaatttaggaagaatcggcacctaatagtgtacattccaatttaagaccttgataatttatttaaatcttctttactattataatattcttgattataattttcctcaaaagaggcttgcacattttttgttagatttactccttagtatttcatgttttgggttgctattttatcaactaattaattaattatttagagacagggtcttgctctgttgcctgggctgagtgcagtggtacaatcatagctcactgcacccttgaatccctgggctcaggcaatcctcttgtttcagcctcttgagtaggtaggactataggcatgtgccatcatgcctggctaattgtttttaattttttgtagagatggggtctcactatattgccaaggctggtctcaaactcctggcctcaagcaatcctcctgtcctggcctcccaaagtgctaagatgacaagcatgagccactacatctagcctgctattttaattttttttttcctgaactgcttttctaaacaattgctctactgtaaacaaatactgttgaattttgtatgttgacttttgtatttagcaatcatgttagattttaaataatttaataatcaatctgtgaatcctttgaggctttctaaagagacaccctatcatatttaataatggcagatatattgctttattactttctagctcttataccctttaattcttttccttgtcttactgcactggctaggacatccactataaagctgaatagaagtagtgacagcaggcatccttgtcttattcctaatcttaaagataatgttttcaacgttttaccataatgcatgatgtatcctgcagatttttttgtgggtcccttttacaagattttaaaagttccatttcactcctagtttccaagagtttgtcatgaatggatgttaaattctgtcaaatgctccctctccacaccctgttatcttgagataatgagcatgtttttcctcctttcatctatttcatgataaattatattaattgactttctccaaactgatcaaccttgaatgcgtgggataaagccaacttggttgttatgtattattttgtatgttattggatgcggtttgctgatatctacatgaggatttttgctggtcatgagtggcataggctgcttttaaaggaagtgaaaaggagcagataaaggaaaatgtttcaaatttcagataatgtttcaaattctgtgatgtttcactgccatcttgtggcaggaagcaatgtcagcagtaaacagctttaaaattttagccaaggttatttcacacttaagagacaatttatcatttagtgaagctcttcagagaaagccagggataaagtctacctaaatgatatactaaaaagtattggaaaacctgaacttgctcttcctagatgcctctggttcaattcatggattagctgccaagaatcaagctcttcagatatgggtttctcaatttcagcctgtgatgactcaaccaacttacactacacaaggtcaaaaagatatcaacaggaatggtaatctctattagaaaaattacttcagccctttctcagaagcacactggattcctaatttcatcaagctgtgtttcgttgttctttctttagagctagtggatatagaggtttagtttttaagggagtagtgataggagactgtttattaatgggaagtgttgttgacaggagggggcttagctcttacacagtcctatagggatagtttgggttggttatcagaatcaaggctttcttagctagagagtcctcaggaagaggcttaccattctggaattgtgtctctactcgcaggtactgccggagcagatccatcaccacagccttcatgtggcctcggatgccacttcggtacctaggcaaatagaaagtctccactgaaaaacctgacaatccaacactattaagcaataaacccaaaggccaaatttacctccacgacattccactgaactgctttccctctgaataaagaacagcctaaaatgaactacaaaattaacttaaattctaagcctaaaagaaatctcactatagacaagaccttttttaataaagaagacaacaaaatcctgcatagccccacctaccaacaccttgattcagttcctactgctaagtagaaattattaccatactcttgaaatggctgagatatctgaaaaatttataagtatcttaaagttaaaagtgttctgtgaggccggttgccttagctcacatctgcaatcccagaactttgggaggccaaggcaggaggatcacttgagtctaggagctccagaccagcctaggcaatatggcaaaacctcttatctacaaaaaatacaaaaaaattagccaagcatggtagcatgtgactgtagtcccagctactcaagaggctgaggtgggaggattgcttgagcctgggaggcagaggttgcagtgagctgagattgtgctactgtactacaacctggatgacagtgtgagaccctgtctccaaaaaaaataaataaataaataaataaataaatatgctctgtgaatatccctttagtattaatagcaacaaccacaattacttttgcaccaacctaatataataggctccataagctaagaagaaaaaatgtcatactgggccctgtgacagaagaaaaattaggagcttcatcaaaatggcaaggaaaaagaaaacaacaaaatttctgtgccttattaattgacaggctggacgcagtggctcatgcctgtaatcccaacagtttgggaggccgaggcgggtgggtcatttgagcccaagagtttgagatgagcctgggcaacatggcaaaaccccagctcttctaaaaatacaaaaattagctggatgtggtggtgcacagctatagtcccagctattcagaggggttgaaacaggaggatcacctgagcctcaggaggttgaggctgcaatgagccatgattgagccactgcactccagtcggggcaacagagtgagatcctgtctcaaaaaataataataataataaataattgacagaaaaaaatgtagaatattaagaagtcagaaatattgagcatgagagttagctcacaattctaagatatttagaaaagacaaggtactttctaagatataagatgctttccaatttcttgaagtcaaatctgaggtaaatttttttgtgaccacttgaaagaaaggaagacatgagtatggacaggtctgggaatctggagttacaagttactacctctgtaccagctgaacaatgctctgagtattcataaagaagacttcccgttcagatttccggttcaatgtagctgcatggctatctaggatgtttgcaatctaaggtataaaaaagggaaaaaaatgaggcccaacccaacaaaatgccccaaagcatcagcctctatagcacgaccagtaggaatcttcttcttataacatggcagttcctatctcacatgttggcagcagctggaagttaccaggcgtagtctatatagagaatcacgctacataagcaagcagatttcatcccttgtcaccctttcccagatgaattaatgactacattacaaaaactatcatcttaccaatatctgttcaaggtcaagatccaaacatcactccccacttatctacctatattccctacacatacatctgctttatgggtaaagagtaaagatgctgccaaggtagtaagaatgtctctgaaaataaaactaccaataggccatgtgtggtggctcacacctgtaacctcagcactttgggaggccaaggagggaggatagcttgagcccatgagttcaataccaacctgggcaacataacgagacccccatctctataaaaattttttaaaaattagctgggcatagtggtgcacatctgtagtcccagctacctgggagactgaggtgggatgagccattgggcctatggggtcaaggctacagcgagccatgaccgcaccactgcactccagccttggcgacagagcaagaccctgtctcaaaaataaataaataaataaataaacagctgggcatggtggctcacgcctgtaatcccagcactttgggaggccgaggtgggcggatcacgaggtcaggagatcgagaccatcctggccaacatggtgaaacccgtgactactaaaaatgcaaaaattagctggcatggcagcgtgtgaatgtaatcccagctactcaggaggctgaggcaggagaattgcttgaactcgggaggcagaggttgcagtgagccgagatcagccactgcactccagcctggtgacagagctagactccatctctaaatcaatgagtgaatgaatgaatcaatcaatcaactaatatcactctattttcaattcatgaaaatacctctaattagggaatagccccaggaacaaagctataaggtatacatgatccaagtgtgcttttctcataactacagatacttatccttcacatacagtactttcactgttgggtttgtaccctgaggcagttttgtgaggaatacaatgcttaaaagtatacaagcacaacatccaaaaagtaaggaggatccaaataggaaggaatcctacaacataaactctggcattggtagccagaaaaaaatatagtgttatcctataaatacctgctggctgggaaactgacagaggactgatgtgatgttgctagcatactgagccatttccttcttgatagacttctccacattggggggaatgcggccagacacactggtcataatatcttgcaattctaggagaggcagggagggatctctgagggttttcatcaatcgctctacccagtcttttacctagaaagaaagcattggtaaaataggacccaagttaacacaatcccccaaataaaaagatatatagttgtcattctgtatacgtgggaaattggttccagaaccaccactcatatatgaaaatctgcacatacttgagccctacggaacccatgtatagaaatagttgtgggttccatatctcatcaatactgtaattttgatccatgtttggctgaaaaaatccacatataagtggacccacacagttcaaacctgtattgttcaagagtcaactatatctgaattcactatcatatactacttcttttcaataaaaatttatataattttcaatagatatggggtcttgctatgttgatcaggctggtctcaaactcctggcctcaagcgatctttccatctcagcttcccaaagtggtgagattacaggcgtgagccaactatcatagagtactttgaaattgcaacgtaagcatctaacattgcccctattctccagtttaaaaaggactaatcacgggtgggcacagtggctcacgcctataatcccagcactttgggaggccgaggcgggcagatcacaaagtcaggagttcaagaccagtctggccaacgtggtgaaaccccacctctactaaaaaaaaaaaaaaaaaattagccgcgcctggtggcacgtgcctacaatccccactactcaggaggttgaggcaggagaatcacttgaacccaggaggtggaggttgcagtcagctgagtttgtgccattgcactccagcctgggcaacagagcaagactccgtctcgaggaaaaaaaaaaaggagtaaccacaattaaatgtgaagtccatgacaaggataagaaacatggatttaaagacctcaagtcccacaactgaaggtgaaagagttctaggccaaacagctttcttttcctccctcttaaacaatcattatgagacttggaactattttggagaataggtatcccatttgtacatcccttccccaggagacgtgatacataccttgctgctaaagaaaggatctggaaggcagtatccattcattacattgaccagattatccaggacataatggaacactcgatggagtttctcgcctctgagtgccgtgctctggatccgtggcagactacctgtgtgaagttcagcctgtcaaccccaacaagagatcaagtcatctactacttttgatctaaggtacaaacacaccactgcacttaagagttatcattcaaaatcgagacatcatacccagctaccaggagggaagtcaatagaggaaacatcataaggaaattacagaatcttagtactacagtaactcttgcaaactctagttccataatactacaggcacaaatacaaggcataagattaataggggacaaagctaaagaaaacactggcaaaccaagcattgaaatcacttgcctctccaaaccaccaagttctttagctcttagagagcaatattcggagcaccttcctactcacctgctgaaccttgctggggttgtccagttgcattttggctagtacacagccagggtcaagagctgctccaggtcgcttgacgtaatggatacagccagactccacagctgttaaggtcattaccatcttcattacctatagtgaaaaataaactagactcagatttatctctctttacacagatgagtgcttaaaagaactaaaatttttcccttagcatctaagttggaccacacctaatttgaccaagaaaaaatgggaatttaccatcatctcctagggactatcaaggcaagcaattagaaaatctctcagtacctcactttaggaattaataacagttattgacatttctcctttctaacttttacaaccattttggcataatttgtgattatatttgttttgtacttagaaagtaaggaacaatttaatatcctcataccagtgaatccaatctaagacaaccaggccaaaacctaaggatcattcttcactcctctttctcccttacctaccaattaccaacccagccagacatatcttctaaacctttctcaaaaatcttcctctcttgccatctcttcggtttacgccttcttcatttctggcccaaagtacttcaaagaccccctaagagatctccctacttgctacatacctccctcaaggtcacgaaaagcaatcttcctagaccccaaatctcatcatactacttttccacttaaatctttcagagattacctgctgcctccaggatagtgaaaacttactagtatggtttataagatccttcataacctcacattcaagatctcacattacttctttagcacctttgcttgtccctccccattaaaccttagtctattctcaagccacaccaacacatacttgcagttccctaaatacactgtgctgtcttgcttctgtctttgtacatgctattccttcaactttaagcactcttccctgcccttcttcacctgctctatcactatctgtctttcaaaactaagatcaaatgtctcttctttcagaatatcttcccatacaagcttagcttgatttgggttaggtgaccctctgcactctatgcttagctctcttaaaattaatcacatgacatttcttgtctgttttgtgccccacctccatgtattttctctggatagccagcagttaggacacctaacattcaacaagtgctattgcctagtatctatttttagaactagagattcctcatttgcctatgtgttttaaaaatcttaaggttcgcacttctaattaagccaactgatgtttctttttcattcttatttccaatctgttacctttttttttaattttttagaaatagggtcttgatttgtgacgcaggccacaaattgtaccactccagtacagtggtacaatctccattcactgctgccttgaattcctgggctcaagggatcctcccgccttagacaccagagtggctgggtctacaggcatgtgccactgtacgccgctaattttttaatttttcatagagatggggtctcaccatcttgcccaggctagtctcgaactcctgggctcaagcgatcttcctgcctcagcctcccaaagtggtaggattacaggcacaagccactgtgcccagcctcctttctgtaacttttcagtcctagtccatcccagccgacccttttcctaccttcccctcccatgatcccacagtcctttcaccaccctgacctcaatctcagcatagcactggccggcaaacacatgacctccatcttctacaatgtactggattaacttcccagcagaaggtgagcgcatcaccgatgggtcattttccttctcaaacacacaggttttattgccaattgtgatgcgatatctaggagacaagtggaagtatgtaagctaagaaagcacctcaggatgtaaaggagaatggtagagaatgtcaaccttcaaagaaaaaaaatcctgaaaactttattatacacacacacagacatattcactgcatatttgtttacaatgtcaattaacataaatttccttcaataaggatcagattaaatatagtataatcatataatggaataccacatgactattaaaaataacaggtaccaccatttaaaaaaacacacacaaagatattgatgacgtaatagctaacatttcttgaagcctagctatgttgtggcaatgttctacacattttcaacatgttaatttatttcattctcataacaccataactggtgttgaacatttgtgaatttcttttttttttttttttttgatacggagttttgctcttgttgcccagactggagtgcaatggcgtgatctcggctcaccgcaacctccacctcccaggttcacgtgattctcctgcctctgcctcccaagtagctgggactacaggcataagccaccacatctggttaattttgtatttttagtagagacagggtttcaccacattggccacaccggtcttgaactcccagcctcaggtgatccacctgcctcggcctcccaaagtgctgggattacaggcgtgagccaccgcgcccagccacatttgtgaatgtatttaaagaaaaacagtatgtacatgagtgtaacttgtatatgcatataaaatttctactcaaatatgtaagaaacttttaacaatggttacttataaaaaggggaacttatttttcattgtccacatacactggagtggtagggagacatgtttttaattataaacactttaatactcttgatatttttgttaagtgcatgtactattttttttttttttaactacaaatgagtaccaagaaaagcctgggaaaatcccaagagctagtagctaataagagaaaaggctaacaggatgaccagcaaatggacctcaaacagccacttacctatccacttcctctttcatatacgtagtataactgctgccatcataggacaagagcagtccaccgtcactcagccgatgtacatctacttctacacatgagccattcatgatcaccacataggagttgggggactgtcgagtcacctgtagggaatgagaatgaggatcagtgtgtcccttccaggtacagctccaaatgaaatttgaatgcttcaaaaatacagataagaaagatctgtcaggaggaagaaaattcatggcactgatgctatttgcatcagtgtctgtggacatggctcagtcctgctgtaagcaaagagggcaaccttagttgattttccccaactgtggttgttccctgtctctcctttatctcttggcagtgtatgtgaagttgaagaacaacaaaaaagattttcatagaacaacaaacgctgcttcaggacactgacaaaaataatgacggtaatttcactaatacccccatccctgcattaaatcaaactttttctcctgcctctcaacctaaagaaagatagctaaaaaagtaaggtgcaagctccaatggggttctgcataccttaagtacatacttgactccctcatagataagttcaacatctactgtattcagaagtgtatgagcaggaaggacttgacccctgaaagaacgatgagagaggaacttactacaaagttctaacagttataagagaatctaaaacattattgattgtagcatttcctagaataacaaaagactagaaacaacctaaatacctaaatgatcgtttgtaaggaattgatcacatcaattatgaatcttacaatggatttttttaaattagggtaaaatacacattacattaaatttgccatcttaaccattacaaaatgcacagttctatagtgttggggatattaacactattctgcaaccaatctgcaggactttttcaactggcaaaagtgaaactctacacccattaacaactcccaatttcgccctccccccagttcctggtaaccgtcattctactttctagttctatgagtctgactactcttcatacttcatataagtaaaaccatatagtatttgtctttttgtgacaggcttaattcacttgccctaatgtccttaagatccacctatgttttagcatgtgtcagaatttccttcttctttaaggctgaataatactgtattgtatgtatatgccacattttgtttatccagtcatccatcaaccaacatctgagttgctcccatcttttagctactgtgaataatcctcctatgaatgtggctgtgcaagtatctttcagaccctgctttcaattctttcagaatacccagaagtggtattaccagatcatagggtaattctatttttaattttttcagtaattgcaataccatttttcaatagtggctgcatcattttacattcccatcaagagtgcacaagtgtcccaatttctctacgtacttgccaatacttgctattttctgttttttgacagtgggcatcctaatgggtgtgaggtggtatctcatcatggttttgattttatttacttaatgattagtgatgttgcgcatgttttcacatgtggaacaaaacatacagacattaaaaagatgtgaactaaaaaacactttaaaaaatatactgttgagttaaaaaagcaaggtaaataacagcttcacagcatgctaccatttgagttttaaaaaaccaggaggtgggaagaaacaaatattgcatgttgatatggttcggctgtgttcccactcaaatctcatcttgaactgtagctcccataattctcttgtggtgtgggacggacccagtgggagatacttgaatcatgggggcggttcccccatactgttctcatggtagtgaataagtctcacgagagctgatcattttataaggggaaacccctttcacttggctctcattttctctcttggctgccaccacgaaagatgtgtctttgctcttcctttgccttccgccatgattgtgaggcctccccagccatctggaactgtgactcaattaaacttctttcctttataaattagccagtcttgggaatgtctttattagcagtgtgagaacagactaatacacatatatatgttcatgtaagtttagggtatctttggaaggttagaaaagaaattggtaatatgaatttactataggggacggaaactggatggccaaggaacagaggtaagagagagacttctcactgcttatcttttttgtgccttttgaattttgaaccacatgaatgtgttaactgttcttaaagataaagattaaggttgggcgcagtggctcacgcctctaattccagctatttgggaggccaaagcaggcagatcacgaggtcaagagatcgagaccatcctggccaacatgttgaaactccgtctctactaaaaatacaaaaatgagctgggcgtggtggtgcgtgcctgtagtcccagctactcatgtggctgaggcaggagaatcccttgaacccaggaggcgaaggttacagtgagcagagatcacgccactgcactccagcctggtgacagagcaaggctccatctcaaaaaaaaagattaagattaaacgcgaaaaaattataaaacttcagtgtaagcatatctgctcctagcaactgaaactttatttgagagtctttaaaaaggccgggcagccgggcacggtggctcacgcctgtaatcccagcactttgggaggccaaggcgggtggatcacaaggtcaggagattgagaccatcctggctaacacggtgaaaccctgtctctaataaaaatacaaaaaaaattagccgggcctggtggcaggtgcctgtagtcccagctactcgagaggctgaggcaggagaatggcgtgaacccgagaggcggaccttgcagcgagccgagattgcgccactgcactccagcctgggcatcagtgcgagactctgtctcaaagataaaaaaaataaaaataataaaataagtaaaaaacaaaagcattttaaaaggaggtgggtggggggcttgtagaggaaaatgcatttgacatatttgtacaccaataagaaaactatttaactaggttacagattatatgttgcagaacagaaataaataagactggattggtaaaaagcggcccatgtatacagggagttgaaagtcacgccaagggatttagatttgatacagaagagaaatgccaagctgctgaaggttttactacatgagagtaacatagtgaaagatacttatcataggacttgaataactctgaaatctcagttcaatttttaaattttgtttcttttctttctttcagatacctcaaaagggagttgatataagtctaacaacacagaaggaaataaaagtgcctgtgattaaagtgctttaaaatgattagccacttggaacattcctctggggactcaaaggcagagcttagtctcctcaatcagcaatagaaattagtttagccccatagatgtctgaccctctacttgaaagactcatgaggtcatcctgaatatcagccttaattatttacttctgaaaggtggtacaagtaatacatgaaatatttagggttcagtgctagggagaaataccagatttttatcaccagggtttggagagatttgatacttatacaggacagaatatctactgcagatggattccagtttttaaagaagcaacctgttctaactgtggtataagttaatgtctagaatctgcagtttgactccccaaataatttgccataaatgtcaacatcccctctctttcttgccaccatggtccatgaataacaagtagcactcataagctgccaggaatggacagaagaataaatgggtctttgagcttcagtccctgtactcagggccattgattagtttgtgtagcctacaagaaacaaagcctacctttctaaggagtgaaggaagttagagacgctattccgcaggctcacatctgccacgtggagggcaccacacacaacccccaacatggtgtcaggtcgctcagcctgaaaggaggaaaaagagggcagatcaaatgcatggtcacttggcaccacagcctctcaaatgaaatcaggctcaaatttgttgtgatgaaacagctagcaatgaaaatctccattctcactgcccaactgattttttagataaaaatgaacacattcacttttagaatttgattagaggcaccacttgaagagaaatgaaaaacaactttcttcttttctccctaagacttccacttagccaatcattgaatagctcaaaaataggcttctgacagaaataaatttaaaaagacacaacgatttggctactgataatctcaaagaaaaacggtgtatagccaaaatttggacctccaaattatatgaatctaacgattttatacaaaatcttggataatttagcatagccccaggaattaaggaataagtgataactcttgatctaaatgaggcctctctcttcagcatctggtagatacagaagttggcaactatggaccaggtttaacattaaatgaagaaaaagaaagtaattaaatccctgcatgcctcacttcaaatatacctcaggaagtaatgctagaacataaaatgactgtgtgacacaagcacaggaaccatcagagtgctaaaattacactgactcctagatttttccaggtagatcaagaaccatttacattagaatcaaataaatttcatgtagtggcagggattgagtacacaagtctataaaaacccaatcccagcatctgtttgtggagaaatacacacctgtactttttctgctatcagtctgtccagccagccagtatcaattctgttcatctgaaagctttcagtctctaacaatttgatcaggtattcaactgtagttcgaaagtcaccccgaatagacagctccttcaaagccaccaccatgtttctgggagaacagaagccaatctgtttcagcaacaaacactttaatgtttttcaataattttaaagatctgtttggccaggcatggtggctcacgcctgtaatcctaacactttgggaggccaagacaaggcggatcacgaagtcaggagattgagaccatcctggctaacacggtgagaccctgtctctactaaaaatacaaaaaattagccaggcgtggtggcgggcgcctgtagtcccagctactcgggaggctgaggcaggagaatggcgtgaacccgggaggcggagcttgcagtgagcagagatcacgccactgcactctagcctgggcgacagagcgagactctgtccccccaaaaaaataaaaataaaaataaaagaaagaactgtttcattcctttggaatcttgagagggaagggagagaggcagttccaaaaacaaataagggtgcacatgtcaagtgtgctcattcatgtgcattcaagagagggaaatttgcaaaaagtcagaaaacgtatgaattctaactgatattaccataagagcatcagcaaatcagaaacatttcattataatgagtacagaacaaattataacaaattatatgcaagtcaccctcagcttttacttactaagtttccattattccattcatttgttgttggctaacaagaattagggcattaattctccctatccttgtaccttatttattttatgtataatttacatacaataaaatatacttattttaagtatacagttcaatgaattttcccaagtgcttaatttaaagatttccatacagtaaagcaactctctgggtgcagtcatatatcagcctgacactgcatgtgacagtgttttttttaaaactgcattttggatatctatgcaatgatttgctcattacttttattacttcccagttaagtgcaaagtgatccaattttagcagaatttcaaatactatggggcttttctgtatatttatgcccagtgtctatcctgcatgggacaggtacttacttccacaaatactaattatgtacctcatactaataagacacatactatgattgtaaggaagaacataaatacaataatcactttcaaaatatatggcagaatatcatcaatgccagacagaatacttacacaaagttctggagaggttgtaagaagggagaaattcatctccctacagtttcatgaaaaatgtggaaactgacatgggctaaagtatagctgataattataactgtgagaggaatcatattccaggtagtccaggcattccctcagcctaaaatattattctgttgcccacctctgtcctcctttctgtgtcctcctttgacctgacttacttctacaaacttcaattatcaatctagatgtcactgtcttctgggataccttcccagaacccctctagactgagttagttgactcatctgtatgatcctataatgcccttaaataatctgactatcatcatacttaatacattgtattttaactgccaattgtcttacaccctctggattgtaaagttttgtgaggagagagattctatcttggacctcactgtattgccagaaccagtagatagcagatactcagtaaatatttgttgaatacaatgaatgaatgggcctggcacagtggctcacacctgttatcccagcactttgggaggccgagttgggcagatcactcgaggtcaggaattcgagaccagcctggccgacatggtgaaacccgtctctactacaaatacaaaaactagctgggtgtggtggcgggcactccatgtcagaaaaaaaaaaaaaagaataaatgaatgaacagaggaaatagcaagaacaaagaagcagagggaagaaaatacaggttgacaaaattagccaggcatggtggcacgtgcctgtaatcccagttactcaggaagctgaggcaggagaatcacttgaacccaggaggaagaggttgcagtgagctgagatcgtgccactgcactccagcttgggcgacagagcaagactctgtctcaaaaaaaaaaaaggaaaatacagcttgagttcagggaatggtatgattgaagcagaggtataaggataggaatgagtggctaatccattcaaccaacgtttactgaatgcttactatgttcaggggatatagcagcaacaagacacagtcctgttctcatggtatttagattatgacccatgggaaattatactggaatatactggaatatatgagttggggcattctggcaaacaagagtccaaaccccaagctgagatatagacctaatgaaatgaagaaataagaaacaaagaaagctctaagctgaagaatgaacttttggcatagtgtcaagaaggagacttattgtagataacgtatttttaacatgctaaaaattaagctagttagctttgtactgtagacaaatgtacagagctggtcagaaataaggaacaaggcttctggattgggttataggacattccctgaagaaaatacacagtggtctgccaaatcaggacttaaacctaaatgccaacagaggccagtctgggaacataaatgagtgaggcagactgaataggagctgtgttaactacaaagtttatgtcccgtcgaaaagaagcagtcacacaaaactagctgttttttgtttgtttgtttgttttttgtttttttgagacggagttttgctcttgttgcccaggctggagtgcaatggcgtgatcttggctcactgcaacctcagcctcctgggttccagtgattctcctgcctcagcttcccgagtagctgggattacaggcagttgccaccacacctggctaatttttgtatttttagcagagacggggttttaccatgttggcgaagttggtctcaaactcctgaccttaagtgatctgccagcctcggtctcccaaagtgctgtgattacaggtgtgagccaccgtgcccaggcaaaattagctaacttttaacaactagaatgtacaaccaatgttgtcattatagtcctacttttaagagctagcagaaatccatattttgatttcaatctcctgattttttaatattgtcaaattaaaaaaaattaacactttgtgagcccatcaaaacacatctgtatgttgagactcaccagaaagccaacaatttgcaagctctagtgtaaacctttttcactttgcagagcataatatggcagcgaatatgcttaaaaggcaacttcataccaatgtttttttctggtagcagtgttttaattttgaaaaattccacttatagttttgaagaatgagaagaaatgtaaaggacaaaatagagaaataatgagatttccctacttctaaaaataatattaaaaactaattaatcaaggctgggtgcagcggctcatgcctataataccagcactttgtggggccattagagcccaggagtttaagactagcctgggcaacaaagggagaccccatctctacaaaaaatttaaaatttgctggacatgatggtgcacacctgcagtcccagcaattcaagaggctgaggcaaaaggattgcttgagcccaggaggtcgaggtttcagtgagctatgatggcaccactgcattccagcctgggtgacagagcaagactctgcctcttaaaattaattaattcaggaaattgataaaaatataaaactaatcaataagtgtttattaatacaaacaaccatatattaggattaattactaataaacaaatgctatttattagtaattaatactaataaacacttattaattacctactccatgtacagtacaaaggtaaagggaatggtattaaatgtttgatacaaggcaataaaccattaaaaaacagaaaagaactagttcaagtttcaattttagatagatattccaaaagatctaagctgttaaaattacctccttcagccctatgttttaggcaagcaaaagtgctgttaatttaatattcattgtttatgattaatagaatattatctaacatttatgatatagcagttatatttgcataagctgttatatacagcatgctaaggtctcttgtattagcaatgtagacagtttctttatgtccttttcataatatgagcagtataattttattattttaaataactataagagtacatcatggtgactatggctcataacaatagattgtgtacttgaaaattgctaatagattttaagtcttctcacaagaaaaaaataaaataaaagtctatgatttatttgatacctagttcttggccaagaatctacctcccctcaataacaatactgttcctgtggaaaaataagatacctttaaagcaatcaattttatacatttatcaaaaatatttgaaaggaaaaatacttcaaaaggctcagaacaacaaacagaaaaacatctgccaagcactgcataatttaatacaacatgaatgcaagtgtaattaaagatattcaaaatttcttcaaaaaggttgttcatattattactttgacagcagatgattcctattcccatgctcacaccttcacttaagattagcacaaatttattttgtaaaatgcaatcaaatgctattatactcacgaaattgcctcttctctgttttctccccaagaaaagcagtgaccaaactgagaatcagcaaattcatgaagtccccctgcagcagcaacactgaaatatccccaaacattcttattgctgcggaaatttagctcctgaactgttcctgagctgggcttaaaaccctgttagagaataaagaatgagagaccatattatgtttcgaaggaagagaagatttatatattcattgtttaagttctctgttaatcacacacagaagcagagaagacacacaaaaatgataaaggccaagacccagtgccacagacccactgaagactctacagtgacttaagtgggattaagtaaccaatgaagcaacaaccatttacttatctgctctgagaaacctctatgtttcccactccagaggaagtcccaagatatttcagaagtatactttcagatactatcttaacattaaagttcattaaaaggaggtataaaccttttaagtgatgggttacctcatctggattttcactagtgatccgagcagcaataacatggccccttggacaaggaacgtgtgcagaatcttcaaaatcaatgggagaatcaccccagggagataccccatacatcatacggatatccttgattctatatagaggaatccccatggcaatctgaaaggtaataaaacacacatctttaatttttcagttacttcccttaaagtgtagaggctatcagataacctaaaatatttttatttttggagccactccctaaaacattctatttttataacctgtattctacaatcatcaactctaagttgcttgaaatacaatatatcactacagataagtagttagaatattctccacttctaaagaagtccccacattcctaatgcaacagacaccagttcccctgttgtcatttctccatcacgtaataagaatgaaaatatccaacagaggagtaaatgttaatagccatccaaaaacagacagctagaaagtcttaattgtgtcataattatctcttccatccctgcaaaccactggaggaagtaagtaaatctttagtctttaataggaacccagaaggtgttctcgatgtgggcaaatgttagataaaaataatatcaagccttatcattaactattactgctttccataatatttgtttcctgggctgagagaagacaataatattgacagcaagcactttacaaattataaaaatatatgtgtgctaccacactcttgtaaggaaaaacttcaaccactaatctctgatgcagaattatttcaataaagaacactagtaaaaaaacaaaaatgagtagggaataattataatacaaagttgtgaagtttactatagctaaataattgaataaagcatacattattaacatttatttctaaaacatgacacattatatcagatgtgtctggctagaaaaaataacattcctatgtctgtactacatcaggaaaaccaaaccacacatgcataacacatacagggtgaaagagaaatgaccattaggtgtgactcagataggaggtgcttttctcttatcacacactggttaaacccatttttcaggcctctctgacttttctaggctctgcaacccagatcagggagactcacctggagctgtgctgcagggagattgacatcagccaccatctctgtacaagggtgctctacctgcagccgaggattcaattccagaaagtagaagctgccatcctggctgtacaggtattccacagtcccagcactcacataacccaccattttggcaagtttcaccgcacactcaaagaagagagataagcaaacataagtatctcaccttatccaactgctagaccactacagcctctcactgactcaactgttcagtgtgtataagagccatcaaaagcttttagccacatgagagcacatttctgattattatacaatatccctggacaaggatgaaaaactcaatgaaaaatcgggagaaaagagcatttttcactttgcatcaaaagcaacctcaccccaccagacataaatgcatgcagacaaaaaaacatggggacagactcttgtccagtttccagtatttccaatatgctcctcttctttctagaaacatagctaactagttagagactagatttttttttttttttttgagacagagtctcactctgtctcctgggctggagtccagtggcacaatctcgtggctcactgcaaactctgcctcccgggttcaagtgattctcctgcctcagccccccaagtagctgagattacaggcatgcgccaccatgcctggctaatttttgtatttttggtagagatggggtttccccatgttggccagcctggtctcaaactcctgacctcaagtgatctactcgccttggcctaccaaagtgctgggattacaggcgtgagccaccatgcctggcctggttagtggctaagttttgacaaacaggacaccagcattggtaagtgatatgcataactcccaagtcatatatatatatatatatatatatatatatatatatttttttttttttggagatggagtctcgctttgtcacccacccaggatggagcacagtggcgcaatctcggctcactgtaacctccgcctctcggattcaagtgattctcctacctcagcctcctgagtagctgggatcacaggcacatgccaccatgtcaggctaatttttatatctttagtagagatgggttttcatcatgttggccaggctggtctcgaactcttgatctcaggtgatccgcccacctcagcctcctaaagtgctgggattataggcgtgagccacagcacccagccctaagtcatattttgaaaaggaaatgtctcattctctattcctggctttttccttcttattcattggaacatagtcatgatagtataagccaacttcaatcatgcaaatgagaacacactaagaacaccaagaaaagaaaggaaaagaaaagaaagaaaaagaaaagaaagaatgaacctgaatcccaagatggtctcgtggaataaaacacttccaccagccctgaaaagctcacctcagactaggatgggagagaaaaataaacttctatttttgggggggtccgctgtgttttttggacctttttgttatagcagtttaacctgtatcctaatcgatacaggaattattaagtgcaggtagaatgttgctgtttaaaaatattaaaatatgagatgctagcttagcaaaagggtagtgggtagcagagaaacagatactgcaggctggaaaggtgataatctccttgttgggataacacaacatttggtaaactgtttcctacaataacttgggatactgaccacacaccaactaaaccttaaaaaagatggtctgaaagggtcagagtgtcgaaaaagccaacttcttttgtatccccccaaacagaaaatgagattatcaccctgaagcaactcagtgtcaaagatcaaacgtgctgctttagtttcagctggccccaagatagccaatattaaatcaaggcaagagagataggctaagcacagaagccagtaaataatagaagaaaagtttctatatctagaagaaatctatgagtatgattaatccaacccaaagctgattgcaagcaaatagcccagaagcttagttaagtatttgaaggaattgtatttctaaacaaaccacaaacctggccttcaaaagcctgcgactgatgattgggatatttgtgccctcaatcctgcaccagcaggaagtgggttgtgaaagttctgccaaagaaggcatagtctccaaagcccaactcacagagaaaactgaatgaggaagaacttcccagaaaacaatgtcaggtgtcttgaaggacaatgaacaagggatttactcccttattgcacttctctggagtgtgcagtagcagaaccagggacagccaggtctaactgaggtagtattctattatatagcagggaatcattgcaattcctacctaaaaaggaggatttgataactgctatggaccaacgattgctatgtatttttcatttttccaaatgagagttatcctgttcctattccatcattgtatatgggtgtatggtgaaggcaggggatataatactgggtaaataacttgtattttgagtcactggcccatgaaaagccacaatacatatctaatggagaagaatatacatcatatagagatccggaatcacctccagtaataacccatccagttactagtaactggatggggcttcaggttgtcttccttggacaaaggctatgtgtgctctgaaagtaggaaaaaggataaagggataataggtagccagaggaacagactgaggcacagattatgaaatgccctccagtgacttttctctacttcatcattttaggaataaaatcgaaatttttgctgagcacatggtcacccagttagtgatcacaattcctaacatcctttgtgctaggtataattgtgtaactgaattttgtccagtggaatgtgagcagaagtgatgtatgtgacttcaagatcatgcttccatatgcttgccctccacatcccctgtctcttcctcccacaggccacaatgtgaacataatcttgtgtgagttagcttaatcatgaagatgacaatgtccaagagcaaagtttggcaaacttttttggtaaagagccagatagtaattattttcaattttgtgggccatatagcctctgtcacaactattcaattctaccattgtagtgataaagcagccataaataacacataaataaataagcatcattgtgttccaacaaaattttatttacaaaaacaggcaacaggtgagcaataaacctgtttctggtaacagctcatctctgaactatgatgaaagagaaatagaaacttacaccttgtttaagccaccgtattttgcttatttatttatttgttttgagatggggtcttgctctgtcacccaggttggagtgcagtagcatgatcaaggctcactgcagctttgacctcccagtgtcaagtgatcctcccacctcagcctcccaagcagctgagagtacagacgtgtgccatgacactcagctaatttttgtatttttagtagagatagggtttcaccatattgcccaggccggtctcgaattccagggctcaagtgatctgtccgccttagcctcccaaagtgctaggattacaggcaagagccaccatgcccggccaagccactgtattttgaaggcatctttattacagcagttcaagagtacatcctaatatatacacaacataggaaatagacctctaacacacatgaaatatattttgaagaatctattttgatgtagagactgggttaggactccagaaaagactatgttcaggcctctaaactatagttattccgaaggcatcgctcatgactttgagaaactactttctatacaaaaagatagaatgtgtgaactctgaagatatttagaggactttccaaaaacgataatagagttgattaaattcagctgaagacttgatgatactcaacccagcaaataaaactacctgattatgagcctcttaaaaaaatcaatcataagattaaaaattccaaaacatttctcttctttatccctgtatcctgaaatggtacgctgattttttttagaaagcgttaactacttttagaagcttgacatgttccttgacaattctcttagtgggagaacagtagaattttttttctctaagaaaaggatataattttattaattattcagaatcgttgcttaaaatgccattgttctcagattggtacatgaactgaatgaaaaatgttctatgtaagaaaacataaagtaagccttttaatatatgtacctgttccatgtgttcaaatactgctggagtagcaatagtagcaggtgcttcttcaataatcttctgatgcctgcgttgtacagagcaatcacgaccaaacaaagagatagcattgccatattggtccgctaagatctgcacctccagatgacgagattgtttggctagtctcatcacaaatatgggagatccaggaacttcagcttgaacctgtattagaaaagggggaaaaaaaaaaccaattcttaaattttaaactttttatctatcttgataagctactttgatttcaacaagcagatgtccagaagtgtcaggaaccatgttaatcagcagaaatacaaaactgaataaaatacagtccatgctgtcatctttaatatctttaagatgctgcattcttacataaccaatattaattgataaatatgaaaacatacgaacatctggtgcatcacaaaggtaaacaacaaaatatttgaaaacataggcacatacacaaatccaacaacagggcaaaatactgccatcctgtactctgtacaaccaaatgtacaacttgttccagacaagatactttcctggttcacattacatcatatatggtattgttgcagccaaaggactttcatctttagttttgaagaatattactgttggggacagaattctaaaatggtaactattttttttctcagcactttaaataatcccaatgattttcagctttcactgtttctactgagatgccaactgtcaatcttattgttactattttgaaagtaatctttattcctcagctggtttaagattttctctctttctgtcttttataggggggagggtggtagatttactctgataagcatagatgtggttctttgtatttgtcttgcttgaggctcatagtgctttttgaatctgtccttggtatcttttatctgttcaaagaaattcttagcttttctctcttcaaatatggcttctgcttcatcatttcttcaattattgtttctgctccattctctttctcttctcctctgagacttaaagtacatgatgttagaccatttcacataaccatatgtcttttatgctctgtatcttttttgctctgttttgccatgtagcaagtcatctcaaaactcagtggcttgcttagaacatcaaccttttatgatgttgttctcatctgggcagttcttcttctggtcttgcacttacatacatatcatcatctggtagcttgagtggggtagaatggtctcactcagatgtctggtgatttgtgctgactgctggctggtaggtctagggagcctcagctggaatcgttcatctccaatgcaggtggcttctcatcctgcagcaggctagactaggcttcttcagtgatgtgttccaagaggggaagaagctgtaaggcctcttgaggtctaggctttcgaatttatacatcactttggccacattctaatggtctaagcaagccacaaagccagctaagattcaaggggtagggaaaatagatgccacccctggaagggaggaacagcaaagtcacattgcaaagggtgtacatacaggaatgggaggagttattgtcgccatctcttgcaaacaacttactatgctctaccctatggccacaataattcacatacctcccacatgcaaaacagactcaccccctcccaagacccccaaagtctcatccaatcatggcattgggcttgacgtccattttctcatgagtcatgtccagaagaaaatgaggttccttgggtgcaactcctcaggtacagtttctcttgatccaaagacctgggaactaagaagacaagttatctggcccaacactcccaatatttatgatgatattgggaggggataactgcaaatgagactgctgttcaaagaggaggaaataggaggtacatagtagtcattggtccatagcaattctgaaatccagataggtacatgctgtcagattcccttactccagggtcaggaatgcttttcattttgttttgttttgttttgtttttcaggatctagtttggttccctgggagtaggtccttaatccatggcatcccctgctcctagctctgccctctgggctcctgactccactctctgagaaatccctctttttatttgaaatgacagctatttacagctgaatagctttctgtctgcttcctgctcattaaaaagtttaaggctcagaggtcacttttcattttgaactgtttctggccctttcagtcccttggtgcattcatcaacacaagtctcttgacaactttgtgggtttcctatgaatcatattggggttcaccgctcacccaaagagacacatccacaactcatgtctgcatagacctctctatactttgggcacgtcaggatgctgtgagacagtacccttaagatacttagggccaggcatggtggcttatgtctgtgatcccagcactttgggaggccaaggtgggaggatcatctgatgtcaggagttcgagaccagcctgagcaacatggtgaaacctcatctctagtcaaaacacaaaaactagccaggcattgtggtgggcacctgtaatcccaactactcgggaggctgagacaggagaatcacttgaacctgggaggtggaggttgcagtgagccgagatcgcgccactgcactccagcctgggcgacagagtgagactccctctcaagaaaacaaaaaaaaaaagatagttagaagcatgtttccagctgaaagcattaaaaaaaaaaaaaagatacttagaagcatctttctagctgaaagggtaatttattagctactaccttaaagatttctgaggccttaaagtcacaggcactcttgacttggtctttactctgaggcattttttactttgcaaatcttttgccagctggagagactcgggatgagaaacaattctattttcaacaagttctgggtcctttacatttctgtaaattctgcttgtaagcaaaacatcttctttagcttacctctcttttacagttttttagcataagcaactagaagcactccacagatactttaaacacttgtagagagctccttaaccagatccatgacttcattaaatatattatttgtcttccaagttacctcagataacatttttttgccaattgttccattattacagaacatggatcttttttccagactccagtaacaattactacactgcttttccagcctcccttaacaattcatcattcttccagtcttcattaacatcctcctcaccaatgttcagcctacacctatgagccagttttaaagtcaatgtcttacgttttacttttctgttatggcaacatcataccgttaggtatcaatttctgtgtcaattatccattgatacctaacaaactaccaaaatcttagtgacttggtatagcaaccattttattttatttgctcatgagtgtgtggatcagcattttgaactgggcacaactggcagttctgatcttgcctggagtaattcatgcagctatagtcatctggcagctcaactggggttagatggtcaaatatggtctcatttacatgtctcaaatgtggtgctgctgactgtcctagtaggactaggaggccttagctgggacaactcatctctgctcatgtgacctctccttctctagtaggctagaatgggctcttcacatggtagtctgagggcttgctccaagacagcaagagcaacaactacaaaaccattgcaaataatttctcacattgctctatgtttttcatccttttgtctttcttcatgcttcagtctgaatttccttctgatctactcaccagtcgttaattatttatctttttctagatttttttgttttgtcacccaggctggaatgcagtggcatgaccatagctcaaggcagcctcaaactcctgggctcaagggattctcccatctcagtctccagtgccagttactgattctcttcaactgcatctaatatgctataattttaaactcctatattgacttcttcttcttcttctttttttttttttttaagacaatgtcttgctctgtcacccagactggagtgcagtggcacaatctcagctcactgcagcctctgtctcctgggttcaagtgattctcccacctcagccacccaagtagctgggattacaggcatgtgccaccaggcccagctaatttttgtatttttagtagagatggggtttcatcatgttggccaggctggtcttgaacccctgatattgacttcttaattttagttattgcattttcagttctagaacttttgtttcttctttatgatttccagttctctaccaaaattctcaatcttgcctttactttccttgaatatattacgcagaattactttaaagtccttgtctgataatctcattatataaaccctctgtgggtctgtttctactgttttgttcttcttggttttcaatcatctaattttgtatgcctattttcaattgagtggttgataagctgtaagaaaaattaatagaaataattttaagttctggatgttatctttctctggaaaggatttacatttgcttcctgcaggtgtctagaagcactagcaatcctaaaacatcttgcttaaatcagaggttgaatgttttgaagccaagatttagtccctgtgagggctagtctatttccagttcaccctttctcccatgatgtagtcagtccttaaagatcctaacctaaaatgtgggaggttttccagggcacccctccccaggaagccctcttagtcttttaagactgttgaaaacttatcagcctttctactatcttgaactagaagatatatctaggggaaaagtagcctcatatgtcaggctcacatctctgggtttcctttttctcttgtatgttagccccataattcttcactgtcttgaatggtctctaatgccgtaaaatgtaatatatctatatctatatctatctatctatatatatatatatatatatatatctggttcagcttttctagtttgttcccaatgggaggattagtttattcagccaactagtattgaaacttaaggactttcacagaaaaccttcccttagtgttttaagacttttccactatttgattccataagtaatgagtagttttgaaatgtctgtaagagttaacattaattaacatgccttttttttctttttgcttctaagagcagtcttttttctctagactctctgagtcactgatctacctatgaaattagaattcaatgaaaaaaatgtaaaaaaaaaaaaaaaaaacccaaggtaatattcaatttctgacacttaaaataggataatgtagcaaaacaataccttatttattgatttatttattttacaattttttgtagagatagagtctcactttatcttccagactgatctcaaatttctggcttcaggcaatgctcccgctttagactcccaaagtgctaggattataggcataagccaccaatcctggccaagacaacacctttatcacttcctttatctagtacagatgctctttgacttacaataaggttatgtcccaataaacccaacataagttgaaaatgttctaagtcaaaattgcatttaatatacctaacctaatgaacaccatagattagtctagcctacctcaaatgtgcttaaaacacattagcctacagttgggcaaaatcttctaacacaaagcctatattataataaagtgttgactatctcatgtagtttactgaatgttgtactgaaagtgaaaaacaatagctgtatgggcactcaaagtaagatttatactgaatgcattatcacttgcacagtattgtaaagttgtttgtttgttgattgtaagttgaaattttaagttggggaccacctgtatatgaaatcatggaagacccagctcataagactttccttttaactcttaacagtgaagcaaggagtttgctgctaagtgttttaagggaaaaaaaaaaaaaaaaaaagcgaaataaaaggtagcatggcacactagtaaaagaagtgcaaagtagaagatgatgaggaaactatgaaaaagagggaagctaggagagtgaaaagagcagacttctgtcccaattttccattttttgacaaatcttttactatgtattggtaggaggaaaaaaagtgagttaaatatgtgagggtaactctgaggacagaacaaaaagagacccctgtctcccttttctctttctgtttaagattctaaaaagacatcacttctttggtcgtctccgcaaccaatgtatagtatggccacatcaacttggctgcaaagcagagggtaaggcaaagagagatcctacatcgagctttcctgagtcactctcagttcctatatactgtaggcctgccatagggttcctgtgccagggtgtggtggccatgcaacacgggctagggtatagagtgctgggacagcagggtagatgagacatatgatagaaactcagaggtctctaggcaatgtgaactaaagtgagaaaaagtcaatcagagagcctgggcctggccaagccaagagcaaccatatcagtatcataccaccatatcacatatgacctacaaagtcagcagaacaggggcacaaaaatacagaaaggtattgatttttctttgtcattatgaggtcctataagccatacgcaccatgtaggaaagagctatctgacaaactgagcacgtttatataagacagaataactctactgtttgaattacctaattaaataaaacttaaaattgagttggacatttcattaaccttttttctctgctaatatgcaggtagaaactagagagaaagacagttagctatagacaaaattaaaaattaaatattttctgggcatccaaattatagtatgagttaaatcatatatctctgatatacatgttagttcaaacaaacaaaaacagcttatactctacctgtctgaagagattagggaagtcatctgcattgttgacttttctaattcccttccctcctcctccctctgaggccttgatcattactggatatccaacttcctcagctgccttcaaaaagaaagaaaaaaaaaatagaagaaacagtgttattaccagggaaggagaaaactggcatttttctccctttaagaatgcagtcatttagtaattctaaatacaataaaatagaaagatcttcaagatacactatgaaaaaataaatagtagaacaatatttgtagtattaggttgaaccaaaagaaattgcctttttcatagatttaaaaaaatgactgaatataggcaatttcttatggttcaatctaaagtaatgtcacatgggtcaaaaacaaaattatatatgcattcatacacccacacatgtaagtgcaaagaagtgaagtccagagtacataccagcaatgatttagaaaagaatgggtccgggcacagtggctaacgcctgtaatcacagcactttgggaggccaaggcgggcggatcacctgaggtcgggagttcaagaccagcctgaccaacatggagaaaccccgtctctactaaaaatacaaaattagctgggtgtgatggcgcatgcctgtaatcccagctacttgggaggctgaggcaggagaatcgcttgaacctgggaggtggaggttgcagtgagccaagatcacgccattgcactccagcctgggcaacaagagcgaaactccatctcaaaaaaaacaaaaacaaaaaacaaagaaagatgcgtggatataaaactttcctttttcactgtatgtatttctgcattattggaatttcttgcttatagtatgcaggcatacatgtattacaattaaaaaaaaaaaagacataaggagttcacttaaaataagctgaagtggggttgggcgtagtggctcgtgcctgtaatcccaacactttgagaggctgaggcaggtggatcacctgaggtcaggagttcgagaccagcctggccaacatggtgaaacccctggccctattaaaaatacaaaaaattagctgggcgtggtactgcatgcctataatcccagctactcgggaggctgcggcacgagaattgcttgaacctgagaggcaaaggttgcaatgagccaagatcgtgccaatgcattccagcttgggcaacaaagtgagaccctgtttcaataaaataaccaagtcattcctttgtcaaaatattccagtcttttaaggttttgctacattataagaatatctttaaaatgtatcaccaggcctggcccagtgcttcacacctgtaatcccagcactttgggaggccaaagtgggtggatcacttgaggtcaggagttggagaccagccagcccaacttggtgaaaccctgtctgcactaaaaatacaaaaattagctgggcatggtggcggtaacctgtaatcacagccacttggaggctgaggcaggagaatcacttgaatctgggaagtggaggttgcggtgagccaagatggcatcactgtactccagcctgggcaacagagtgagactccaacccaaaaaaataaaataaaataagtatcacccagaaaaagaacatttcaatttttaatctatgtcaatcgattacttaatgaatgaaaatcttttatgcacagtctcaccttttctaatgtttctttattcttttctatgctcatataaacagaattagtatgatgaactcaattgctgagtgatagatgatcaaagagatagcttaaaaaaaagagaaagacttaaaaaaaaaagggggtatcccataggaggtcagtaagtaagaaggtaggccttttaaaaatatatgaaagctttagtcacaggtcacccattaaaaatattttggaagaattttaacactttaatataatgttaagtaaggagcggggaggtagaaggacaaaaaaatattaagtagaaaaaagtattatgattaccaacacaatacaaatagtaagacccaaaacttataattatcataattataagtataggaatctattaataaagatttgtatatgatataaatctatgagttgaaaagggataaaaaaatgaataggttaatgggcattatctttggatggtgtgtttgcatgtggctttatcatcatctttggcttttcaaattttctaccagaaaatgctgtttataattataaccagaaaaaataaaaaagaatgttagtcgataagcaaaatagctagaatagctagttccttacaaagagcttctactcttttgcaaattataacaaacaaaataaagcatttgaaattcaattagaaatattaattcttcttattaaggagattacaggatgtttaacttaaaatgcaaacaatacaacaaaattatttgaacattcagcatccctcttgaatttacatgacacaagtcaaactcaagcagtgtatttttctacaatagcctctttcattatctttcattatacctggaagcataaccaacactttaaactatttataaaagtgaaaggggaacaaattggagggaactgtaaggaaagaaaaggtaatgttggggaaaggatctccttttgcctaggttcacatttctacatggatagacaataattaagagtaacactttcagtctttcttggttcactcccttgctcctccccaagggaaaaataataaattatgtgattggtcaacttggaaggagggactgaatatgcatagctcagccttttcccctttgggatcagcccactgcacaggacatatgctctttgtcagctctcagccatacactaagctgaattaagctctctctctctgtcgagggaaatctgtggtcattcagcactgccagtaaccagtgggtgagtgagcctgcttaactctggtgtttagtttacaaatctgaatgttgctacacacttaagccattttcatcaacatctctgttcataataaagctgactgtttgatctctgcttcctggcttcttggttctgaattcaaccagtagaaaaagtatgttgtttgttgtccccgccctcacacactaacaggtggtagagagagagagaatcagcacctccttaaaactctgacttaatcacctaagaaatgttctgtccagatgagcagcctgcttcaaaatgaatttagattgtttacatttaaagtcacttcctcaatctgtactttttaaaggcaaaagacttatgcaatctaaagagaaaccagcgtattctatactttcaaactacacctcctggtcttacatccctaacaccaccttgggtatatatcacgagccaggctcccaatctccacatttgtgactataactggtcagctgaaaggtatcactccctggagttagtaacctacctgtagcccatcatccacatctttcacataacctttttcatatagctcctggggaacatttaagatacgttttgaaaaatcattttcctgccagtccacacgaagacctgcaacagacaatagcaacttagggcaattacaagatcttctgctcttgtcaattttctgctctgcattctttgaaatgctatcatatttacccaaaactgagagtggatgggagaaagaaggatgccataaaaccctgatcagtccttggggttaacaggatttagccacagcatgacccggcaacttgggttcttaacgctggcaaaagccagccgaactaacagggagcaacttataaaaatgcaaagacgtacaagatcaaaacaaacaaaaaaagaacatagcatacttctcacagcaactcagcaggcaaaataccttcaaactgtgtgttcaggcctgctccagggccaagaggtctgggaaataattcaatctttatgagcccttggaaatagaaatggcggttttattggcctcagcagagtcatgattccatgctctctgaacgtccctgtactcagccataaggggaacactatagcctctccattcaaacaagaacaaattcaaccttttattttaaactatttgacccagcagatctggagaggatattgcaatctccctggagagccagagtaacaagggttcaaatctgttcagcctcaagacagtggtcattcccatttaaaagaggttttagtgtatgtctgttcccagtgcttgagtacttaagaaaaaaaaaaaaaaggttcatattgttatcagctataataattcacatggaactgtttaagggatgtgttgagaataaatcactttttgaaaattcttgcccctctggcatgcctggaagaaaggttaattactgacctcattttctgcatcaagggcaactgaggttgaatggtttttaaacagtcaaatcaaatcatcaatagattgtgggttgatatcaagaaaacattggcgccaggcgcggtggctcatgcctgtaatcccagcactttgggaggccaaggcaggtagatcacaaggtcaggagttcaacaccagcctggccaagatggtgaaagcctgtctctacaaaaaaatacaaaaattagccgggtgtggtggcgggtgcctgtaatcccagctactcgggaggctgaggcagagaattgcttgaacccggaaggtggaggatgcagtaagccaagatcatgccactgcactccagcctgggcaacagagtgagactccaactcaaaaaaaaaaaaaaaaaaagaaaaaaaaagaaaaaaaacattggcaaggaaacatttgagtaagtgggttttaggtttttcctagtgatccaggctactcccaggcaggtctgaagacccaattccccctgggaagcccacctctgaggaagattctagcctacccagagtacatctaaacccacaaaaccatatatatgttttcccagagtttttctaagttaactcacaagatcactccagatcacaatttagcatctgtgtacctggaactaaatttatattactaaaagaatcacaggtgtattaattaagctaggagctacaaggtaccattaatcaaccagtattccatttcttgtcaagtataccaatactttttcaaaagaggtaagtcccaaatatcctactgagctattctgtacttcaagatacaaacaagaattcagttcttaccactgccgctccagggaagagttgggatacctgcagtttgagccactatggaagatgcaatcttatcccctaaagcccacatggcctggcttggaggacctaaaaacgaaacaggaaaagaatcctgactgtaaccccttggcctcatttctggcacatgtagttgccttgtattatagctatttatgtatttgtcttgtcctccccccacccctcacatatcaaggagatcataaattatggggactattatgctttgacttatctttgtaccatctgtaaaacctaatgtagtaagctttttgtgcagagtgagagctcaatatatataaatgtatgctgaattaaatttttgacaaatctagctataatgttatcattcttcatgatccaacttcaccagatcaataaagtcttcttttttaagtcaatatcctgaaataaggactttaaagttttaggattcaagtctgaaatagtatacgctctttggtcttaggggaacccaaaaaggagacatctttaaaaaggtttacaaaacataatcttcattgtttaaggtctctgagacagagagaaaaatactttgagctatataacctctgtttttctctctggtataatgacagcagaaaagtcagaagaagtatctctcacttgtaggagtatcacctatatgcttaaatgcacaggtgctgattcatatttaagggcacactgccaaggcatcctgagtattcaattatcttcactatctaaaaacaggtcattttcccacatgctttcttaaggttagctgcaaagttttaaaaggtcagagttttagaaaccaaagccttctccatatctccatatctgacccagggacagaaaacaaaatcaagatgaagtgagataagcaaaaaatgaaaaaaaagaaagaaatgaagagggttactctgagagttagtaatagattgagggaaaaaaaaagagagagagagcccagcacatgttaaacagaaaatcagactatagagtaaaatgtgggcaaaattgacagaaagaaacagaaagacggacaatatgtcagaacagcttacccatgaaggcaatgccatttttcaagagaagttccggtagtttgggattctcagaagcatgaccccagccagcccacactgcctgcaagggaatacaatataattcattcttaaaattcatacaaaacccccacaaactgcaagagtctctatccaggctggccctgtttcttgaggtacagtagttccacagcagcctaatgcttaattcagcttctatgcttgattgttggcaaactctttacagagtaacaataagtagtccattgtggcaagatttctgaaggggtcaaaaccaagttgaaattgatattaagatccagttatacttgttgctctttaggaaactcaattcatagcctaggctgtaaagggcgttttctagaaaaactggctatgtttcacatattcaattactatggccacgccattacatcattattgattacactgccatctaagtttagagttttttcctctttgggctttaaggtacctaccctaaacttactaacacaatgtgacagggaagaaacagcctacttctttaatataccaccatcctttaggctaatattccacaacaaacaggtaatttttactggctcaaaggtgagatacctagaataaataatctctgaaagatgcttccaaaccttctgtttgtattacgtttactttatttttagccattccattatttccatctttcttttccttatttggtttagttatcccatacacaggcatttaataattttcgaaaatgatgctttacaaaaatgttcttctctagatatccccttgtgcctaactataaaatggctgaatttggttttaaaggacacattggcatctcttacttgtactgggatccttttagcaatatcaagaattaattccacatttgcatagttgttgttgtttggtcctccaggcactggcacatagtgatctgccatcttaatgtattctgaaaatgcaagcgaattaatagagaacacatgatttttttttccagaaatataattgcacagcaaaactacgtaaaggtcagggactatcataagtaaccacaggacaaacagcattagtaggataatttccaggaccatttagttcgaggctcttagtttgttaagtcacaagcactaatacgagttaatcccatatttagaagctcttatagtaaaatagcaattctccaacatttcactatgtaatctttctgaggaatctttatgacttctatatcaaggctgatgtgtctgtcagttaggggcccaagtgcaattactctattccgagaaaaagttctagtcctgacatcctttgtctttaactggtactggacctagagaaagcccttttcctggtacagagcttgacagaatggagaaagataggagagcctgaatggcttgcaaactggctaaacaagaaaggttagttacaggagtgtctggaaagagtttatctggaatactgagggtaacaggtatttgtaagaaactttagaaagataaccactttctcatatatatttgttgtacagtattccctttcaaatttgtcacctaacatctctattttcctattctggcaatgacacctgtaacagaagagctaccacgtgtagggactgtaactagcactttgtatatatattatctcatttaattctctcatcaacccaatatgtgacagaaaatgatggcttggaggagttaagtaacttcctcaaagttcatttccaccatttataaatttattttagctttcaaatttcaactcaagcatccaccattatttactaataataaatttattttatcttgttcttttttaaaaatgtaagttccaggatacatgtgcaggacatccaggtttgttacataggtaaacgtgtgccatggtggtttgctgtacctatcaacccatcacctaggtattaagccccacatgcactggtaaaggacaggaacagacagacacttctcaaaagaagacatttatgcggccaacaaacatattttaaaaaaaacctcaacatcagtgatcattagagaaatgcaaatcaaaaccataatgagatatcatctcatgccagtcagaatggtgattatcttgttcttatttctaaaagattttaagtcccttctaaaaaaaattctactaaaaaaaattccgctagaatttcttcaaaattaaaataggcttattgttctctttgattataggaaggaaagcatgcaaattattaaacaatgttagataatacaacagaatataacaatactatattttaaaagtgaaaattggccaggcgcagtggctcacgcctgtaatcctagcattttgggaggctgaggtgggcggatcacgaggtcaggagatggagaccatcctggctaacatggtgaaaccccatctctactaaaaatacaaaaaattagccggggatggtggcacaagcctgtagtcccaccacagacagagtgaggctgagggaggctgaggcaggagaatcgcttgaacctgggaggcagaggttgcagtaagctgagatcacgccactgcaccaacctgggtgacagagcaagactccgtctaaaaaaaaaaaaaaaaaattagctgggcctggtggtgggcacctgtaatcccagccactcgggaggctgaggcatgagagtcgcttgaacccaggaggcagaggttgcagtgagccgagattgcgccactgcactccagcctgggggacagagtgagactctcacctattgtcccacctcaaagacaaccagtttatgctttactgtacataaatatatatatttttggtatatatatgtttaatattttttatggatacctaatatttcaatagcctatataattcatttgactactaacttatcaatggaagtacagattatgtataatttgaaaaataataaaataatgtgtgtctctgtacggctgtccaattatatccacagatatgttactagcaataaaactattgggtcaaaaggtattcacattttcagactctcactagcaacatgggtaccaaatactctcacctatgttaggtattatcaatgtcttcaattttgtgagttttgtaagttaaaaaaaaatctttagtattgttttggtttagatttcttttttgtttgtttgtttgtttttgagaccagatctcactctgacacccagactggaatgcagtggcatggtcatggctcactgcgacctcgacctcccgggctaaagtgattctcccacctcagcctccggagtagctgagactaccggcatgcgcctctatgcccagctaatttttgcattttttgtagagacaatttcaccacatggtccaggctgaccttgaactcctgggttcaagtgatccgcctgccttggcctcccaaagtgctgagattacaggcgtaaaccaccatgcctggccctccatgctttttatcaataaggtataatctcttaatcttaaggtagagtatcttcacagataacatgaagaataatatggtatcaaggatttgcatcaaaataattgtgcacggggttaagaatatagatgaaactagattcgccataagttgataattattgatattgcatgacaggtagatgggaagggattcattatactcttcaacttttacatagttaacacacacacacacacacacacacacacacacacacaccccaaaaaacacattcatttaaaatgcaaatccttagatgtccaacacacacacatactctccttaaaagacaaagtctgtgcttttgaggatggaaaacaaggtcccccttggcaaatactacatcacatcttgtagccatccgtaatttctagaaaaccacttgtgtcatacctttatgcatttgcaatgctgttctttctgtctggtacacctttctctccccccaattgcttcactaactcttactcattcttggttagacataatctctttcagaaagctgtctttctctctttttttttttttttttcattgagactgagtctcgctttgtggcccaggctggaatgcagtggcacgatctcagctcaccacaacctcctcctcctgggttcatgcgattctcctgcctcagcttccgagtagctggatttacgggcaccagcaccatgcccagctcatttttgtatttttagtagagatggggtttcatcatgttgaccaggctggtcccaaactcctgacctcaagtgatccacccgcttgagcatcccaaagtgctgggattacaggcatgagccaccacactcagcctaagaaagctttctcttaagcctgcccccaagaattagatgtctcatctctgtgttctcaccggaccctgtgcatgtttcttttatagcacttacctcattgtattgaaatcatttgtttcctagaacaagatcacatcttattcaactgtcagtctccatgttaagtgaatgaataaatgaattaattggagtaccaggtagaaatgaatgaggaaaaagaaaccggaccgggcgcagtggcttacacctgtaatcctagtactttgggaggccgaggcaggtggatcacaaggtcaagataccgagaccatcctggccaacatggtgaaaccctgtctgtactaaaaatacaaaaattagctgggcatggtggcacacacctgtagtcccagctacttgggaggctgagacagaagaattgcatgaacccaggaggcggaggttgcagtgagctgagtttgcaccactgcactgcagcctggtgacacagcaagactccctctcaaaagaaaaaagaaaaaaaccacgcaagttaatctgtatttattatagatgatctcatctttacaattatccagtgaattagacattaggatcttccttttataagtatgaaacttgtggctcagagatgtgaaagtgtgcatctaaatgatttcatataataacatgatatagtttgaatgtatgtccctcaccaaatatcatattgaattgtaatccccagtctcggaaatggggcctggtaggaggtgtttggatcatgagggcagctccctcatgaatggcttgggccatctccttgatgatacgtgagttctcactctaagttcacatgagatctggttgtttaaaagtgtgtggcaccctccccacaattctctgtgttgttcctgctctggctatgtgatgtgcctactcccccttcatcttcccccagtaagtgtcctgaggcctccccagaagcagagcagatgccagcaccatgcttcctgtaaagcctgtagaattgtgagccaattaaacctcttttctttacaaattacgcagcctcaggtatttctttatagcaatgcaagaatgatctaatatataacatttgctttctaataaattggtgtcttctcaatttctaaataagatgatataataacctttctttcttaggaataatcataataccattgtctcaacaaagaaaaaacatatgcagactaaaataagtataaaaggatagctctttttcgcagcttcctaggagtaaaagataaaaaaaagtaaaaaaacatagctcttcacattatctgtgggtactctaccttaagagattataccttagtgatagaaggtatggagaagaaagactagtcatatctttcagctataccaacagtctttatctacaactatcagacagagaaccatctgagtaaaaagaatatgtagccgaatttacagagtgaaacacacttcggtcccaaaaggtctctccctcaggaagagaaaaaaaaaatcttaacccaaagtttttctataattcaatataacgcataaggaaaaaacagcatttccttctaaatctttccacttacgcattccaaagaatgtggcatagcaaatatttaacactgaaaaaggcatacacttgaaagcccaaatcaacacttttgttaaatttcttcctacttatccctaggacacaggaatctgtatcgaggttgactatagtgcaatcatttttatatgtctattactgacacattttaaacagaaattattttaaaaggattttacttggaagtcctatgtttgggaatccccctaagttaacattctcctacttaaaggctgtgctgttccatgttttagttttgagagtgatgctttcataatgctaataactcacctgcattggctttaaggtcttcaggtgtgaccatgacaacgaatctaattgcacgttcatttcgaaacatttcataagaccacctacggatagaccgcatgcatttcactgctgcaatgccattgttagcaataagaacctgggagggggaaggagatgggaatgggaagaaaaggcagaaaaaagcaacaatggaggaaaagagatgagagaatttttacatatctatctttctgtgtaaaagtcatactttcaaccaagaattcttgttactggtccagactgttagaaactggcttccccaaggccaagcagtatctttaaatgttaactaagcaaatacttgagtatgtgccagctaaaacatactcctttctaacttcatttatttgaagggaaaagtcacaattacttaaatctgtgactttgtgaattattctaccatactaccatattgtgggtatggtatattatgaaatcaggaatgggggaaggccaaccagtgcagtgccatgcactcttctctgttgcaataaaatgaggtacagagcactgaacatgtttaaaaaccctggtattagttacttttctccaaaatactgaactccaataccttagaattgtagagaatgcctcagaaagaatggtcactgttgtagaaaaatagaataatcctgagactttctgtaaacaaacctttcgtctccttacctatcttgcagtcatgcctctaaggataacacagactaatagacacataatctgtctttattggaagactaataaaaggatgctgatgaagtaatacttttaggagtggaaatacaggtccccatcctttaatcttttaatcactggaagctatttcagccaagtcatcctctcagctctgacatggtttagacaaaagtgacacggaattacatttcaaaatacctggaatctctaagtatatcatgtggtatattcccttgaaacatctcaaatacttggtggaagccagtaagtcacagtgtatcaaactctttaagccttctcttctgaaactctctctactcccttagctttcaaaccagtgctgtggcatattatctccccaccagcacccacaagctaatcaattcttcataccctgtcagatcagtgcagccccaccctgtaaaaccacaagatctttcaaaaacatgttttgtttgagacagggtccctctgtcgcccacgttggagtgcagtggcacaatccatagctcactgcaaccttgaactcctgggctcaagtgatccttccattttagccccccaagttgctgggactcaaaaataactttatgagcactattttaactccttaattagctatgattaaattatctgtggtaaatacatattataggaaaacagtgaaattatattaataggatgctagggaggcagaaaggctaaaattcacataaagaggcaaagcctctgagaaactaaatatcaattgggagcaaatctagacaacaaatctaggcaagcattaaatcctaagtgcttttgacaaaataattcagcaagttacaacttaccttctcaatcactttatttcccccaaagcgagtaacaaattctgctggagaagccacagtgaaatctcgttgagaatctattttctttctgtctcggccctgctttactaggtgcaagccagacatgctggacctataaaaatacagaagccataaaaacaccacctatattttctggagacctgcttttcactaccatacccataacagtactttcacaactgcatcctgtgaagactgcatgctggcaggtcacgtacttttcaaataaaagagagaaaagaaaatgatcttgcttgtggaaatttaaggaaaaaaaagcgtttctgaataataaaagataatatcaaggtttaccagcagatgccatcacaaagagataggcaaaggataaatggtagaaataatagactcagagaccgttaaagccaaaaaacaagttaccagggttgtttctggatcacgactctggtgtgcagatgaccttcacctctgtatctctgacttctatctttcttctgagctataactccacattttaaaactgcctactaaatgttttacctgggtatctcctaggtatttcaaaatcaacaactccaaaacaaaattctttacaaggcagcataatatgccatatttaatcagttttaaggttctacttcttttctttttactttaaaaaaatctcctaggccgggtgcagtggctcatgcctgtaatcccagcactttgggaggctgagatgagaggatggcttgagaccaggaattcgagaccagcctaggcaacatggcaaaaccctgtctataaaaaaaatacaaaaattagctggcacagtcgtgtgttcctgtagccccagttacttggggtggggggtggggggcgcagctgaggcagataaattgcttgggcacgtgtggttgaggctgcagtaagtcatagtcatgctactgcactctagcctgggtaacagaatgagatgggtgtctcaaaaaaaaaatctgaaattggtatgtattttacaattgatgccttattaaattggcagtactgtttttgttgttgttttgagccagagtctcactctgtcgcccaggttggaatgcactggccagatctcaactcactacaaccttcgactcccaggttcaagcgatgctcctgcctcagcctgcagagtagctgagactgtaggcgcgccaccacacctggctaatttttgtatttttagtagagacaaggtttcgccatgttgaccaggctggtctcgaactcctgacctcaggtgatccgcccacctcggccttccaaagtgttgtgattacaggcatgagccaccgcgcctggctggcagtactgtattttttcttagtggtacataaaataacagtgtttctaacaatcaatggcaccttggattagacaaaatatgatagtggaaacagcacaggcctgggtttacattccagatctgtccacttaaatgatcttttgcaaataatttaaccttttcagcttcagtgttctctttgtaaaatatgcatgatatttactgtcctggttatttacctattgtctctcagctccaaacctacccttttatgctgtgctctgtgacaatggggccaagattctgcaaacttcatttccaagactcctttgctagctccttcctgttctgttcaccaaaccggaaggcagaaaggtaagaaaagggccttccttcctatttcccagctgttatcagtattgctccagctgtaacagaaacttaattccagtctctagcttctttcaacagtctggtgaaaagccatagaggtaccagcagcagtgggttgtggctctttggcagtcagaatatcaaccttgccatgctcactcatcctctggacctcactgcctgggcctatcaatcacctgtcaggccaaggatctgagtaccagctacccaaagcttatgcccagaggtccaggcaccagccctccaggagatctccaccaagctcctagttctggtaacactacctccccttttgttctcccagacttagaggtgatagctacttcctctagttattaactctggggtacctcagcatgccttttttgttgttgttcttttattcttctaacacccaattatgcaattctcgctattgaatgttctctgtttataacacctactacaatttattttccttgtgactgcaccttgactgatagaccctccaaaagagtgttcagaggattaaataagatagtggacataagctcctttgtacaccgtttgatagacagctgttttcttttcctattcccaccttttcttcccttcccctacaatttaaacttgatggggcagtaaggtgtcttttcaaaataagaaggtatgattaaaatcttcccacatgcagcacaatatctagctttctgtgcacatatagttttacatatacatacataaataagaccagtctttctttcttctctgagtgtctctatgcataaaactcaatgagtgggcattttccctatacttcacatgacttagtgtggctcttaacttgcaaaaccaccacctacgggagtataacaagaagggacaaggccaggcatggtggctcacacctgtaatcccagcactttgggaggccaaggcaggcggatcacttgaggccaggagttctagaccagcttggccaacatggcgaaaccacgtctctactaaaaaaaaaaaaaaaaaaaaaccaaatatccaggcatggtggtgcacgtctgtaatcccagctactcaggaggctgaggtgggagaatcacttgaacccagggggcggaggttgcagtgagcagagatcaagccactgccctccagcctgggcgacagagcgagactctgtctcaaaaacaaaaagacaaaaaaaaaaaaacaagaagggacagttcagagtctagcagctactttgcctactagacttaaggacagacataacaaaggctatgcactctgctgttggcactcaatataaaatgctctgtacccttcttagagactgacatttcaagctggtcaatctattaaaattttcttcatccttttctatccaggtatttagttatactgcatctggactggaactttaaagttaagaggcaccttatagaaaaagaggcccacaaggagaatgatttgtctaaggtcacaaaggaagtctgtagcatatatagaccagaaaaccaggtttcatggtcatttcaatgttcttccaattacactatgcaacatatctaatgataataaacaccagaggtctaaaaacagtgccagtgtacatgttttgtttcatttttttaatcacttcatttttctttcatacattctttttaatttttttattattgcatgtatttttaaataaataaaaattaccttcctgtccttaactttgtcatgaacctatttcttttgggccccaagtccatggatcattatcagtgtatcagactgagcaataacatgaatgaatctcaaaaacctcatgttcagagaaggaaaccagacacaaaaaagtatataccatatgactccatttatatgacaaggataactaatctacagtgcagaacacgaatcagtgggctggggctgtgggaaccgactgcaagggagtatgggaatgatggaaacgttctatatcttgatctcatagtaatggttacatgggtagatatatgtgttaaaaccatcaaactacataattttaaaaggtgaacttggcctggtacattggttcacacgtgtaaacccagcactctgggagggcaaggcagaaggattgcttgagcccaggagttcaagaccagcctgggcaacatagaaagagctcatctatacaaaaaaatcaaaaaattagccggccttggtggcacacgcctatagtcccagctacttaggaggctgaggtgggagaatcacttgagccaggaagactaggctgcagtaagctatgatcacaccactgcactccagcctaggtgacagagtgagatcctgcccccgctccaccaaaaaaaaagggtaaactttactgtacttaaattatacctcaacaaacctgacttttgaaaatactcatttacctgccaggcatggtggctcccgcctgtaatcccagcactttgggaggctgaggcggatggatcacttgaggtcaggagttcgagaccagcctaaccaatatggtgaaaccccgtctctactaaaattacaaaaattagccagacgtggtggcaggcgcctgtagtcccagctacttgggaggctgagcaggagaatcgcttgaacccaggagacagaggttgcagtgagccaagatcacgccactgcactctagcctgggtgacagagttagactccatctcaaaaaaaaaacaaaaaacaaaaaaatcatttaactgtccacataaaacaggtatatctggctgtaaattattcctcagtaaagttggcttttaaagaactgttactaatggtattgaaaggtaacacagagaataaggctaaggaagtacccacaccttgaaaatcagcaactgtaagtatggcacaatcaaacatttcttcatctgtcctcattatcttcaaccctctaggcacctccacttcatatcccacgagtatttcaaagtctgaggatacaaaaatgtcaatcaaaatgcaaactaggactgatcttcttaggaacttccatttttccattaccccatatacatttagatacctaaccaataccatgtgctctccggcagtaatataatctactctattacagcttggctttctcaacaacaggaatccaccactgcattatagtatttttgtcagtactactccaattcattcttcaaaatgcaactaaactgtcagtgctcccagtgagcctttgctgatggggatccttccaacttcaccccttaaggaggtaggtaactgagcttcctctgtgccacaccagaacatgcacttacatctttcctcccaatcacactggactgttacatgagcttaacacatctgttttccctgataaatagtgtgtgttccttgaggtcagatactcttattcatcccttgaggtcagagattcttatttattgctgtatctccagcaccaaagggtacctggcacagatagaagctgttcaaacatctttgggttttttttttagacagagtctcactctgtcacccaggctggagtgcagtggtccaatctcggcttattgcaacctccgcctcccaggttcaagcgattcttgtgcctcagcctcccaagtagctggaattacaggcatgtgccaccacgctcgactaattttttctatttttagcacagacggggtttcaccatgttggccaggctggtctcaacttcctggtctcaagtgatctgcctgcctcagccttccaaaatgctgggattacaagtgtgagccaccatacctagcctgctcaaacatttttgaatggtgattattatttattaattattgacaactacacaaaataacactatttctgagtactcgctatgggacagacactatgctaagctcttcacatgcactggcatattaatcctcgcaataatgctatgatgtttgagcaccattttacaagtgaggctcagagggattaggtaacttgcccatgatcattcacacagccagaagtaacaaaacagatctgaattcaacctttctgactctaagtccttgaacttgataccctacaatactgcctcaagttaacctgcactgaatatagtcacagttaattattcactgtatatccatgtaaataattatgtttttagagcaggggtatccaatctttttgcttccctgggccacactggaagaagaattgtcttgggccacgtataaaatacgctaacactggcgggcacagtggctcttgcctgaattccagcactttgggaggctgaggtaggtggaccacgaggtcaagatatcaaggccatcctggccaacaaggtgaaaccccatctctaataaaaatacaaaaaattagtcgggcgtggtggcgtgtgcctgtagtcccagctacttgggaagctgaggcaggagaatcacttgaacctgggaggtagaggttgcagtgagccgagatcacgccactacactccagcctggcaacagagcaagactctgtctcaaaaaaaaaaaaaaaaaagaaaaagaaacacactaacactaatgatagctgatgaaaaacacatacacacacacacacacacacacacacacacacacacacacatctcataatatttgtttttgtttttgttttgagatggagtttcgctcttgttgcccaggctggagtacaatggtgcaatctcagctcaccgcaacctccacctcctgggttcaagcgattctcctgcctcagccttcccgagtagctgggattacaggcatgcgccaccatgcccggctaattttgtgtttttagtagagatggggtttctctatgttggtcaggctggtctcgagctcccaacctcaggtgatccacccgcctcagcctcccaaagtgctggaattacaggtgtgagccaccgcacctggtcaaaaatctcataatattttaagcaagtttatgaatttgtgttgggcctcatccaaagctgtgttgggcctcatccaaagctgtcctgggctacatgcagtccatgggcagtgatttggacgagcttactttagagcaaataccaggtgatgtttctttaaaacagtttttggagaacaaatttcttagatctttgctgcccatgtcttccaatgtttacatataagccccaaatacatgccagtcatactaaccattacaaatctcaattctctcaagaactgaaagaacacctgatgatgttattaaataaatgactgatacgattatactaatctgagatgacatatactaaataaatgtagtcttatagttatcaaaaaattaagataaaattaaacatgaaggaaagggcaagagtaaaaggcagtgccttttaggagaattttttttttcattgaaactgtaaaaatgtgaagatactagaatgttaatttgactgctctaagaagtaattttttaactttgcacaaaacatagtatgaatgtcatatattcaattaaaaatgtgcttatgcatctagtaagcaaagctgaactacccttgcggaaatgtgttacctgttcaatggcctaagggataataggtaattttaaagagggtgatacgagcatttgtagagctctatataactgtataacatcatgtaaatttgtatgattttgttttgtgaatatagtttcaacttgctaagtaaagcagtaaggggcaaacactaaacttaccagttaaaaagcattaaacagttagactttgtaatgatagtctttcaaggtttacccttgctgccattatgctgctatgaaattctcaaagcatcttgagaaaaacaagctttgattccccttggaactttctaaacagggcaaagtatataaagtcctctcaagggaaagccagaagttaacaaaaaaaaggcattctataagcaagttaaaagaaagatcagactttaaacataagcatttttctgtgcatcatcctgaaagatttcaaaatgaaaagaagagaataaaaaaggataaagagtttaagaaaggccaggtgcggtggctcacatctgtaatcccagcacttcgggaggccaaggtgagaggatggcttgaggccaggaattcaaggccagccttgccaacatggcaaaaccacatctctacttaaaaaaaacaaaaacaaaaattagctgggcgtggtggtgtgtgcctgtagtcccagctacctgggaagctgagacaggagaatcgcttgaatctgggaggcagaggttgcagtgagctgagagcgcaccactgcactccagcctaggcaacagagcaagacttagtctcaaaaaaaaagaaattgactctaggcaaatgaccaataagtacttcagtgccggcactacccgtgcaaaacaggaaacaaagtgtgaagcaatgcaagcacatatgtgaaatttggctccacactaaatccggcttcatgcttaactatatattaaaaaaactggcaaactgccgacacatttttttttacaatacttatttttactttaatcaagactaagaactttaactatgaaaatgttaattagccaaatttctccagttctctatcaggttttaagcaatattttattatctaaacttttccacgtctttctcccctccttaccggttccttactacattgtttcataaataaccttttcaaatctgtaatttgaactaacttttagaaaacttccgaattagacaaaattattattttttctcactaatcacacaacactttctggcacattttgtatatagaattatgtgttaactagaattcttatccttagtaacctaaaacttcaatgaaacccgaaaaagcaagaaatcctgaaccatcagagataaaagcattatagataagaacaattccacaatttgtagaaacatatttccccatgtcacaaccttttcttaattggaactgacccagatattcaatgagcatcaaaaataattttaggacttttttttttttttttttttttgtgacagagtcttgctctgtcccccaggctggagtgtagtggtgtaatctcaactcactgtaacctcctcttcccaggttcaagcaattctccagcctcagccccccagtagctgggattacaggcacacaccaccatgcccagctagtttttatattttcagtagagatggggtttcgccactggccaggctggtctcgaactcctgacctcgggtgatccaccctccttggccttccaaagtgctgggattataggcatgagccaccacgcctggccaagattttaatttacacaaaaagattacctaaaacatttatcccattcactgtactcaattctttcatgtttaacggtttatttagataacttctataaacagagatatcagacactatcatttaaagttagttatttccttgctaaccatgtttttaatagccagcgaacataaggtgctcacctaaacctaagtaacagccttaaaggtaaatacactggtatttttttttgccaataactcagaagacttagttaacaacattaagttactctcattcgttgaaaaaaaaaagggcacacaaaccaagatcattttgtatgggctaagttagtagttttataaccttctatgccaaacattgacatctcaaaatatttagcagagacaaatataaaatccagacaaagaatgtattctgacaattctgaaggcatttctagttttattttactaataattttaaagccagcttgtttagtaaagttatacttaagtcacgtgaacttgaaaattgcttagacttatttacttaatttttaagtgctcttttatttataagccaatttggtagacacaacatgtaacaataagtgtgcatacaaataaacacatctagacatgtatagacgcacacaaacgaagattcaatcgcttttaactgggaatcttaaggcatgagatagcaatacaagcttggggggttttcctttgtttgccccaacagataatccaatgaaggctgtgaaccaaaatttcagatatagcagtttccacagcagtttgacacatgcaactccatcccactttcccattcaacagcaagctccagattccaaacaatattgggccaaacagtattgcaactgcgagagaaaattctaaggagggcttaatactagacctcagaactctgcctagggtgtcccctttggagaagttgaggtctggaggatccctgggccgtccccctttggggtccagtctcagagtgtcagacgtctctgaccttaggtgggcactggtgctgcttagcatgttttcccttcagaggcaatggcctactatgaggtttccttttgtccctggatgaaggcctggacttctggcatccttataatttgataaggccacactttcccatgcttcctgttccactagagtgatagccatgaactgtaatgataggaactggaggctgggtgggtttcttttgtccttagccagtagagtaggggaagggaagaatttagcatgagaaaacaaggtttaagtcactgaaacaaatgccagctcgccccaagctgtgccacacgtagggatcagggaccacaactggaaaagatagaaaggagtccttcagagtggccccggccagaaacctgcagttgcctctgtgtttaggtgctgcccaccaaccgtcccaagttggaaaggaaaagagagagagagactgagattcccctgtatggagcaggaaaaacaaacaagaaaaataaaccccaaactttgggattacctcctggctggcttgccaaaatatgttaccagtggaggctgtacaagttcttggtgttttgaacaaagaattgaacaaaacacacaaacaaagcagggaaagaataaagcaacaaaagcagagacttaactgaaaatgaaagcacacggccaggcacagtggctcatgtctgtaattccagcactttgggaggtaaatgtggggggataacatgaggtcaggagttcgagaccagcctagccaacatgttgaaacgttgtctctactaaaaatacaaaaattaggccaggcacggtggctcacacctgtaatcccaacacattgggaggctgaggcgggtggatcacgaggtcaggagatcaagaccatcctggctaacacagtgaaaccccatctctactaaaaaatacaaaaaattagctgggcgtggtggtgggcacctatagtcccagctactcgggaggctgaggcatgagaattgcttgaacccgggaggcaaaggtttcaatgagccaagatcgcaccactgcactccagcctgggctaaagggcgagactccatttcaaaaaatcaaaaaattaaaataaaaaataaaaaaaagaaaatgaaagcacactctacaggttgggagctggcccaagcaagccagccactcaagggtctggttacagaattttctggggtttaaataccctctagagatttccattgttacttggtatacaccctgtgtaaataaagatgatgaagttacaaagtcatttattcagtgtatatcctatgtaaaggaagaggatgcttcctgtcataactgaagtgcttgtttccatttgatttagttctagaaagttcttgggttccctgcctccaggtcctactcgcttgcatgattctcattgtgtcctcacagagtggaaggggaaaggcagatctttggagcctttttttttttttttttttttgagacagagtctcgctctctctcccagtctggagtgcagtggtgagatctcggctcactgcaagctctgcctcctgggttcacaccattctcctccctcagcctccagagtagctgggactagaggcgcccgccaccacgcccggctaattttttgtatttttagtagagatggggtttcaccatgttagccaggatggtctcgatctcctgacctcatgatccgcctgcctcggcctcccaaagtgctgggattacaggcatgagccaccatgcctcgcctggagcctattttataagggcactaatcccattcatgagggctctgccccatgatctactcaactcccaaaggccccacttcttgacatagtggtaattagatttcaacatatacattttgtgtgtgtgtgaggcagagtctcgctctgtagcccaggctggagtacagtagcacaatgtcaggtcactgcaacctccatctcccaggttcaagcaattctcgtgcctcaaccacctgagtagctgggattacaggatcctaccaccacacccggctaatttttgtatttttagtagagatggagtttcgccatgttgcccaggctggtctcgaactcctggcctcaggtgatctgcccgcctcggcctcccaaagtgctgaggttacagacatgagccaccgtgcccagcctcaacatataaattttggcaaagacacattcagacactatatatcaatatatacttatagagatatatatgcacgttttatttctatatgtatagccatgaggtttttatataaaaactatgttatatataaaacacatttaaggccgggcgcggtggctcacgcctgtaatcccagcactttgagaggccaaggcgggcatatcacctgaggtcgagagttcgagaccagtctgaccaacatggagaaaccccatctctactaaaaaaacaaaattagcggggcatagtggtgcatgcctgtaatcccagctactcgggaggctgaggcaggggaatcgcttgaacccgggaggcagaggttgtggtgagccaagatcgcgccatcacactctagcatgggcgacaaaagtgaaactctgtctcgaaagaaaaaaaaaaaaaaaccacacacacatgcgtgtgtgtacatatatatgtatatatgtgcgtgtgtttgtgtatgtatatgtgtgtgtatatatatatatatacacactttttttttgagatggagtttcgctcttgtcacccagactggagtgtgatggcgtgatctctgctcactgcaaattctgcctcctgggtttgctcgatcaagcaattctcctgccttggcctcccaagtagatgagactacaggtgcctgccaccacgcccagctaatttttgtatttttagtagagacggggtttcaccatgttggccaggctggtctcgtactcgtgacctcaggtgatccacccgccttggcctcgcaaagtactgggattacaggcataagccaccaccgtgcccagcctatatatacatttttgaaatatatatttatacatgtatatacataaaaaattttgatactatattatatatatacacaaacatagattatatatatctcagttactttggaaaaaaaatttttagagatgggttctcactgttgaccaggctgcagtgcagtggcaggaatatatctccctgcaacctcaaactgctgggctcaagcaatcctctggcctcagcctacagagtagctggtactacaggctcatgccactgcactcagctatattgtagttacttttatacctctttgcctctcagtggaagttttgcttggttatcccctcaaagggtggaagaagtggtaaaaaagaaaaaggggcaattacagaggcagttgggggaaaaaaaggaatggaaaaggatgatctaaagacagattttgccaactcagtgttttttgtttattttctgtctttgcctaagtttagtttaactttcagtaattttcttcaaaataaaaactctacattataaaaacaagcaaacaaaaaagataatggagggatgccaggcacagtggcctgtaataccaacacttctggaggccaaagtggcagaattgcttgagtataggagtttgagactagcctgggcaacacagtgagaccccatctctacaaaaaacttgaaaaaaaaattagccaggcatgatggtgcatgcctgtagtcccagctacccaggaggctgaggtgggaggatcacttgagcccaagagttcaaggctactgtgagctatgaccgcgccactgcacaagcaaatcattcaagtcttttatgtcaattctctgcagggaggtgcagacctgcaagaggcctgaagaaggcccaagaaggcctgactcatttcctcctcagcctgagttctaatggcaataagaaaggtcccaaagtgaaggagttcggcatcctgaacaactctgtctgactacataccacaattacagcaggcacctttcctagccccagacacacattctaaaaaagttttctgcaaaactatacaatatctttcctttacagcagttgaagagacttcactggaaatactagccaaatccagggagtaaatctgatacatctgaggttcccttcaggaaataatagcacagcagggtctgcatggggtgcttgttttcaacgtagctaaaatatcacacatgggctcagggatcttttattcaaattcccaatataaaataaaggtttagacattcaggagccaatatgcccatttttattcattttcttaaaaaaaatagccttcattttttaaagatagaaaaaaaatgatcaaataaatctcagggcttagctgtcagtaccttactgtttttttaaagatatatatattacccaaatgtggtagcctaacacttacctttgaagcatgtaatatctcatttccttattttcctctggagaaccctccatatcaagatgggaaaagaatggaagctttttcttcagatttcggccttgtaaacacaagccgcagttcctcctcctgttgcagctgcttaaaacccaggaggacaagagatactgtgccttctgcctggcttcagtcagactagaatactcctgatggcctcaaactatagtctttttgtctaattgttcccaatttccttctttccccacctttctcttcctttttgcatcttctctcctccacacacttagcttacacacacaattagttgatttcccaagggaactgagaggagccggggagaaatataaaagcttgtttaactagaaagtagatcttagcagctctcctttagttgcagcaaacattttcaacaacagtcactttcttctgacagtcaacggagaaaagctccactgcctctcctggctgccaggagcacatgacagggaaagcccaggacaaaaagaccaaatttacaaggacaattaagccaagaaaataatgggctcatgaaatccagagggaggagcacagctcggtctaaagaggtaatttctgagatccaatcaaaacaaataataccaattatcagactgcacggtggggaaaagcaggtcaggtgggaaagtaagcacgtagaaaggaaacacgccactactagggaacttagaatcaagtgtgagccacgattctaattttcaggccaaagtagtggtatatatagacacctaaactaaggttttatgcaccaaagcttgagaataggaatggagctggtacaaaacggatacagaaaagattgtgggttaaacccttaaaaggaaaagagaccctgacaaatattttggaggtctaacccccttaagcagggaagaaaaatcctgcctagaaagactacttactgagacacatatattactatgaaagcaaatttgccacagacagatctcttaaagaaataaacactagctgaatgttatcttgtaatatcttcctgtttttagcttttacttaagtagatgctcatgatattctgtgtattaggagaaaaatcaatggcaaaagaccctaaaggcttagaatctatagaaagacaacttcctgaggcaagtcctcaggcctgtacaccaaatctaacctgaatcatgaaccataaaaaatttattcccatcaaaatgctggatagaaatagttaacaatctgatgccaaccacgctgagaatatattaagcttccagaaaaaccttcaaaaacagaagtacacaaatgacctggagcatagatagaagttaaataatcagataaaagataaatgattacaacaaacaaacattgatctgaaggacattcgggcaacttaagttgtaaagactcaagttgcccaaatttgaaagcaactcaatcaggccacccaacatgacaaccagctataataaaaaatggaagtcctggttgttctctggtctgtacttcacatcatcccttccacaatgtgccaatgcccattaagttagtcaagtttactttccctttaaagaaccaagctgacacagaggagcccttctatctttacgtctcttcagaataacctgtctcaaaaatagagcactgcagcctttgttcaggaaagttcagtagccacagatgagaagctgctcaattttacacacacttaagtgtctacaaaacaaacttgttatacaagttcaccattcaaaaatgcaaataaagcactaagtgtaaaaataaggcagactattttgcactcaactatatcagaaaaatatactaaagaggcacactcaataatcgagtttatgcttcctttcaccaaacggatctttctacgacaaccaaacactaacacagcatacccaggtccaaaagcaaagctagagatctatatagatcttttatagacactgctgctcacaatctttctctaatattagaatacaagaaataaaaagccacattcatttctccaaatttaaagcatcccccttttaatctaccatgaacagtgtccaacgtagacacatacctggcacaaaatccaactagaagcccacactgatcccagcattgtaacatgccaaacaccaaggatgacgtagcagtttacccggcagacagtgatgcattcgctagcttgactgcaacacagtctgagttatactgcagcacacacactgtgagagactgttttacattgggtttttacaagcagagaaatcttggatcaaggatgtgtctctgtcaaaaaatcaagtgaccatatatttaaaggtttctttgtggactctaaattctgatccattgacctatatgcctagccttgaagcaatgccacatggtcttgataactgtgactttatagtaggttttgaaatcaggtagtatgaagacctccaacttcacattcccttttcaaaagtgttttggctattctaggtcctttgtttccatgtaaattttaggatcggcttgtcaaattctagaaagaaaaagaaaggctgctggaaatttgatatggactgtgaatttatgatcaatttaaggagaactgctgtcttgacaatattgagtcctctaatccatgaacatggactgcctctccatttatttagattttatttaatttcttttttttttcttttttgagatggagtctcgctctgtctcccaggctggagtgcagtggcacgatctccacttacaacctctgccatctgggttcaagcgattctcctgcctcagcctcccaagtagctggaactaaaagaacaccaccacgcccagctaattttttgtatttttattagagacagggtttcaccatgttggacaggctggtctggaactctttttttttttttttttgagacagggtttcgctcttgtgacccaggctggagtgcaatggcgcgatctcggctcactgcaatctgcaacctccacctcccgggttcaagcgattctcccgcctcagcctcccgagtagctgggattacaggtgactgccaccatgccaggctaatatttgtatttttagtagagatggggtttaaccatgttggccagactggtctcgaactcctgacctcaggtgatccacccacctcagcctcccaaagtgctgggattacaggcgtgagccaccacacccggccggtctggaactcttgacctcaggtgatccatccgcctcagcctctgggtttgggattacaggcgtgagccaccacacctggctgattttatttaatttctgtcagcaatgttccacaagttttagtgtataagtcttataccttttttgctcaatttattcctattttattctttttaatgctatcatgaacagaatattttcttaatttcatttttggattgttcatttctagctagcatatagaaatatacttaacttttctatatagatcttacaccctgtgatcttgataaactcatttaaaaattttttgttaacaattttactgagatacaattcacacaccatacatttcacccacttaaagggtacaattcaatagtttttagtatattcacatagttatgaactatcatcacaataaatttaaggacattttcatttcattatatgtgtcatttttttaaagagacgaggtcttgctatgttgcacaggctggacttaaactcctaggctcaagcaatcctcctgcctcagcctcccaagtagctgggactacaggaacgtgcaccacgcatggcaattttagaacatttttattacctccaaaagaaaccccatgcccagtagcagccactcctcatttctccaatatgctccccaatcctagccaaccactaatctactttctgtctttatagatttgcctattacagacatttcatataaatggaataatataatatgtggccttttgtgactggcttctttcatttagcataatgttttcaatgctgtagcatatatcagtacttcatttctttttatggttgaacaatatttcaatgtgtggacacaccatattttgtttatacatcatcagttaatggatattgggttgtttccattttgtggctcttattaataatgttatgaacattcatgtataaacttttatgtggacatatgctttcctttctcttgggtatacaataaggagtgaagctgccagatcatatggttcatatggtgagagtttagttttataagaaagtgtcaaattagccgggcacagtggctcacgcctataatcctagcactttgggaggccgaggcaagtggatcacttgagatcaggagttcaagaccggcctggcccacatggtgaaaccccatctctactaaaaatacaaaaattacctgggcatggtggcaggcacctgtaataccagctactcaggaggctgaggcaggagaatcgcatgaacccaggaggcggaggttgcagtgagccaagatcgcgccattgcattccagcctgggcaacagagcgagactccgtctcaaaaaaaagaaagtgtcaaattattttccagagtggctgtatcattttacattcccaccagcaatgtacaagaaatccaatttttctgcattctcacaaacctttggtattgtgtctatttcttattttaggcattctgataagtgtgtaatgatatctcattgctattttaatttgcattttcctaatactaattaatatttgcattttcctaatacctaataactattagataattataaaacatcttttcatgtgtttatttgccataggtatatcctctttggtttcatttgcttctttttaaaaatcatttctcttttcttattgagaatttctatttattttatttttaattttttgagacagagtcttgctcttttgcccaggctggaatgcagtggtgcaaacactcaatatgctcaagcgatcctcctgcctcagcctcccaagtagctgggaccacagacatatgctgccatgctcaaataattttaaaatttttgtagatggagtctcaaattcctgggctcaggaaatccaccccgcttgcctcccaaaagcactgggattacaagcatgagccactgcactcagctgagaagttctatttattgattcattgttgtcatgcttaaaaaaacagtatttaaggggccaggcgcggtggctcatgcctataatcccagcactttggaaggcagaggcgggcaataacctgaggtcaggagttcgagaccagcctgaccaacgtggagaaaccccatctctactaaaaatacaaaattagctgggcgtggtggtgcacgcctgtaccagctactcgggaggctgaggcaggagaattgcttgaacccgggaggcagaggttgcggtgaccaagatcgtgccattgcactccagcctgggcaacaagagcgaaactctgtctcaaaaaaaaaaaaaaatagtatttaagatggggcacagtggctcacacctgtaattccagagatttgggaggccaaggcaagaaggtcacttgaggccaggagttcgaaaccagcctgggcaacatggtaagactctgtccctataaaatataaaaataaaaataaataaatatgtttttaaaaattatttaaacatgttttcctttaggtctttgaacacatttacagtcgctactttgaaatctttgttaaatccagtatctagggacacttgtagataatttctgttgacttttttcctaaacatgggtcacattttcctgtatctttacatgtctcacggctttttaattaaaaattgaatataacctgtcatgggattagaaaacaaattatgcatatgaacaatttacaaattgaacatatgaacaatttggattctgatttctttcacccatgaaaattgttgttactagtttgtttttttctttcttggcttaatcatttgcctgagctaaatctgtgaattctgtttccctaacagtgtgcagccactgatgtctcagctcattttctttttatttcttggttttatgtttaaatgtggcttttgaggagtcacccctatgtctgtgtagccaatgattagatagagtttatgctcatatacttaaagctagaaaggcttttatcctctgtttatgggtctggagtatgggggatatagagtagtgcattcaaagttcaggtttttcaagtctgccctagctgttactttccgttgggccttatcatgtctcttctgtgcatgtacatgcctcagcctgcaatatgcttgccccaaccacaaacaggcaaagtcactggcctgtgccactcacccactgccaagtggtcacttctcccaacaatgccattgagcatggacatcatccaccacccaaactgagtaaactcccttcaaccacagcatcaaagcagctggtcttcatggtctacccacactggtaaaactttcatgacaaatcagctggggaaaggggaataggaacaatcccagacaagaataccacaaactcctactgttttacggaattttagcagtttttttttttgttttttttgttttttttttttgagacggagtcttgttctgtcgcccgggctggagtgcagtggcactatctcggctcactgcaagctccgcctcctgggttcacaccattctcctgcctcagcctcccgagcagccgggactacaggtgcccgccaccatgcccggctaattttttgtatttttagtagagaaggggtttcaccgtgttagccaggatggtctcaatctcctgaccttgtgatccgcccacctcggcctcccaaagtgctgggattacaggcgtgagccactgcacccggccagcagttttttaatcataaaattctctcaaattattgtatgccttttggttgatttcaagagtgttaaaatggttaattttgtcaagtttgtcaatcttcataattggtttttgtgttgaagatctgccagtctcctcattcagctatacctggaagtcctccctgttttatttactttttaatgaccgatataacttcatacaatgaagtggaaaaatcttaagtataaaacatatatatgtaaaattaatatatatatagccatataaccaatcacctcattaagatacagaatatttccagagtcccagaaggcttacttgtgtcccttcctagtcaatattctcccttaaaggtaaagactactctgaccttttataaccattgatcagtcttgtttactcttgaacttcataaatatagtgttatataatgtatgtactttaatgtctgacttcttttgatcaatattatgtgtataaatttattattatttttttttttgcaatggagtcttgctctgtcacccaggctggagtgcagtggtgcaccctcggctcactgcaacctctgcctcctgggatcaagggattctcctgcctcagccttccaagtagctgggattagaggtaagcaccaccacacccaggtaattttttttgtatttttactagagatgaggtttcaccattttggccaggctggtcttgaactcctggcctcaactgatcctcccacctcagcctctcaaagtgctgggattacaggcgtgagccaccacgcctggccttatgtgtataaaatttatctatgcttaccacttggtcgaatttatggaaaaaaaaattcacccatgttgtgatacagcagtagtttgttcattttcatttctgtatggtattccatcatatgatataccatgatttacttacctattctactattcacggacatttgggttgtttatgaattttgacaatatttgcttatttctgatggataaatgaactaatttcctctgggaatatacactaaaatgaaattgctcactagtgaggtatgtgcatgtttagctttaaatgatactgctaaatagttttctaaagtggctgtaccaattcatattaataccagtgatgtgtaagagtcagtgtgttccacttccttgctaacacttgatattgctcgttttttaattttaccttttttggttgggctatgtgtttaactcattgtaattttaatttgcaaatccctgatgactagtaatattgagcaccttttcatatacttacttgacatttggtatcttcttttgaagtgcctgttgaagtcttttccccatatttctattgtgttgaatgtcttttttcttattgttttgttttgttttgctttgtttttgagacagagtctcgctctatccctcaggctggagtgcaatctcagctcactgcaacctccacctcctaggttcaagtggttctcgtgcctcagcctcccaagcagctgatactaaaggcgtgtggcaccatgcctggctaattttttatatttttagtagagatggggtttcataatgttgtccaagctggcctcaaactcctgagctcaggcaatccatccaccttggcctcccaaggtggtaagattataggtgtgagccactgtgcccagtcataagatccttatagtaggatattttaatattcttcttcagcaactgatataacaagtagaaaaaaaaaatcaaagacacagaagaacaacaaactgaaaaactgaacatacatagaacctataatcaccaactgcaacatatacattcattgcaagtgtttatgaaactttatcaaaatagaccatatactaagccataaagtatcaataaatttcaaaggtctgaaatcacatagcgtatatgctctgaacacaatggattacactaaaaatcaataacaaaggtaataaaatccacaagtgtcttgatatatttctaaacaatttatgagtcaaaaaatcacaaggaaattaagaaaatattttaattgaataataatgaaaatgtatatccaagcttgaggaatataataagacgaatttatgagtgaatacagagatgaagagatggatatcaacaaagccagaagttaattctttgaaaaggaactgaattgataaatttctactaagactgataaaaataaaagaaaaaaatgctaattgccaatatcaggaatgaggacaagggaatcactataaatcctatagacatgaaaaacaagcatattattacaaactttatgccaataaatttgaaatgttagaaaaaaattgataaatttcttaacgactttccattccacccagaaagacatgaaaatctgaataatcctaaatctactacagaaatcaaatacataatatgtataatttaaaaactactagccaggtgtggtgactcacgcctgtaatcccagcacgttggaaggccaaggcaggtggatcatttgaggtcaggagtttgagatcagcctgggtaatatggtgaaacactgcctctactaaaaatacaaaaattagctggcttagtggtgcacgcctgtaatcctagctactcgggagactgaggcacaagaactgcttgaacctgagaggcggaggttgcagtgagccaagattgcgctactgccctcaaataaaataaaataaaaatgaaaatggaaaaacaaaaactactactattatcttttgtgactgttcccaatcagtctttatacctctaccatttattcacaagtatttattttatgtttttatttactttgtagagacagtcttgctctgttgcctaggctggagtacagtagcatgatcatagttcactgcggccttaaactcttgggggctcaaacagtcctctcgcctcagccttccgagtagctaggaatacaggcatgcaacaccatgcccagctattaaaaaaaatttttttttgtagagtataggtctctctatgttgcctaggcttgtcccaaattcctgggctcaagcaaacctcctgctttagtctcccaaagcgctgggattacaggcatgagccacgatgcctggcttcaacaagtatttattgagtgactattatatgctatagaaaatgatgagtatacagctataaacaaaatatatggcttctgtgctcatgttacagtataatggagacaagaaatcaaataaatatattactaaaaacattacaaattgtgataaatgctattgcaatgggaaaaaaaggaacactgtaacaatagagcctctttggggaaatgatatttgatctgaaacctaaaggataaagacctcaagtgatcaaagagagtgaaagtgaattctaggcataaggaccagtgcatgtggccttgagataggaaaaatattggactactatcttttcaggggaactgaaaggccagtatgattgaagccctgtcagcaaatggaagttgacagaagtcagatcattcagggtctcatgagctgagttaaaaattttgtatctaggccaggtgtggtggcttacacctgtaatcccagcactttgagaggtgaaggcgagaggatcacttgagtccgagactttgagaccagcctgggccacatagtgagaacacatctctacaaaaaaatttaaaaattatccaagcagggtggcatgcacctattgacccaggtacttgggagtctgaggcttgagcccagaagcttgaggctgcagtgagtcctgtttgcactactccagcctgggtgacagagcaagaccctgtttcaaaacaaaaaaacagaaaaactagaattttgtatcttatgctatgtgcagcaagaaataaggaggcaaaagtataatacagacaggaaatctagttaggtgatcattctaatagtccaagcaagagctgacgtgctaaggcttggactaaggtgattgcaagtgaaggtactggggtcaataccggagatagaatcaaccaaactgaagtacaattcccaggttttttggtttgagcagagtggctggaggtgctatttagtgagatgtggaagattgggggaggatcaaatttatgaagaagataggggaaatcaagaatttaatgtctataagacattcaaatgaaaatgtcatatgaataggtgaacataacaagtgatctcagaggataggtctgggatggatattataaatttgggaatcatcagcatataagcagtagcaaagggatgaattttatatatagaaaatgtggctgggtacagtggctcacacctgtaatcccagcactttgggaggcagaggcaggtggatcacctgaggtcaggagtccaagaccagcctggccaacatggtgaaaccctgtctctactaaaaatacaaaaaattagccaggcatgatggtgggcgcctgtaatcccagctacctgggagactgaagcaggagaatcacttgaacccagaggcagaggttgcagagagccaagattgcaacattgcactctaccctgggcaacagagcgagacaccatctcaaaaaaaaaaaaaaaaaaaaagaaagaaaatgtatatcaagtaaaaagataagaaggaccagaaccaagcaatgaaagtattcaacactcaaaggttgcatgaaagcagaaggacttgcaagggagactggagattggtaagagtagaatggaggtaacacaggagtcatgaaagtgtagtctttagcagaaaagaaggcatgtgtttcaagaaaaaagtagtcacttgtatggaactgttgagagacttagaaggatgagaactgaaaagcatccactgatttagcaatacagtagtcattagtggtttttacgagagcagtttcaatagcatagttgggcagaggacagaacagaatagctttaagaatgaatgggagatgaggaagtagggatagcacttctgaaaatcttgaccataaaatggggcagagagataaggcaataatccaaagggaatgtggctatcaaaaaaaggccttctataaagatggaagaaatcagagtgcttggaacacttctcaggaccctccctcctttggtcatcctctgttccaagcacttggaacacttctcaggaaagaaggaaaaatgttgtcagcattgttctgggttacaaaacacacacacacacaaatacacacacacacatacatacatatgcatgaagaaaaaatgagaaggagaatacagataaaagtaagtttgaaatgaggtgttagaagaattactagatagtctctattttcttaataaaataatgtggcaaagctataaattaaaagtgtctagaagaggcaggaaatggcacaaatggaactgctggtttaaggacaatggagaagaaatgaaattactgttgcagaaaatggaaggccaaattaccagaagagaaaaacaatataggagaaagaacaagaaaagcttcatattagttgggcatggtggcgcgcacctgtaatcccagctactcgggaggctgaggcaggagaattgcttgaatccaggaggtggagtttgcagtgagccaagatcatgccactgcactccagcatgggtgacagagcaagaccctgtctcaaaaaaaaaaaaaaagaagaagaagaaggagaagagaaaaaagaaaagcttcatagcagaggcagcatttcagaaggtctttaaagattgatgacctcagatgggcatggtgactcacacttgtaatcctagcatttgggaaactgaggtgaggagatcacttgaggccaggagtttgagaccagcctggacaacacagcaagacttcatctcattaaaaagaaaaaaaggagtgatgacctccaagggtaaatggaatttcaacagtcagggaaatggcatttcagtaaggatacatgacaaagagagacacaggaaaagagactgagacacaaatagaatgatcaaaggacataaagatggaaagtatatggaattttaggaaacaggcaattgtctactgcaactggaataagcaaagagggaaaaaacactgggtagaaacaagactggaaaaatcagctatggcctaattgtggaagaatctgaataccatgactgaatgcctccaccacttattaggtaggaaaattacataatctctctgagcctgtatcctcctcttctggaaaatggagataattaacgcctattttacaggactgactgttgtttggttacataagataaatattgaaagcacttagtgcttaactcacagtaaatgctcaataaatggcagtaaaagttggggttgttatcttgggctttactctgaaagcagagggaaaacattacatgtttttgaacagatgtgaaacagggagagactaaagtaagagaaaatagttaaaggccattgtaatagactaggctagagataatgaacacctacataaagtcagtgatggtgggaactgaaataataaaggcagctgggcccggtggctcacacctgtaatgtcagcatttcgaaaggccaaggcagaagaatcacttgagtccaggagtttgaaaccagcctggacaacgtagcaagaccccatctctacaaaaaaaatttttaaagaaacaaaaaaaatatataaagggaaaaaatatagagatgacatgacacaattagtgggtcatgatacatttggcagatcaggatatcctggaacccaaattcaatattctgaacactctgaagaatctttccttgatgaactcctagacattttcctgactaatggagtcccagtttcatgactatcattagattttactagggaggaggttagaatttttacttatgaagaattattaaatttagcattttgagataagaattttggggggttgcaggagggagagcatcaggaagaatagctaatggatactgggcttaataccaaggtgatgggttcatctgtgcagcaaaccaccattgcatacatttacctcctgcacatcctgcaggtgtaccccataacttaaaatagaagttgaagggaaaaaaaaaaagaactaaagaactatgaatcttgggagaaagaatactcagaaaaatatgagatatcaaactatggttattacaacttcattttcatttcaacaaacagtatctccatctgacagaggattgatagccagaatatataaggagctcaaacaactcaataggaaaatatctaataatccaattttaaaataggcaaaagttctgaatacacatttctcaaaagcagacatacaattagcaaacagctatatgaaaaggcgcttaacatcactgatcatcagagaaaagcaaatcaaaactacaatgagatataatctcactccagttaaaatggcttttacccaaaagaggcagtaacaaatgctaagaggatgtggagaaaagggaacccttgtattggtggttcccttgatggctgtataaattaaaacacaatgggaatgtaaatctccatacaaccactatggagaacagtatggaggttcctcaaaaaactaaaaatggaactgccatacaacccagcaatcccacagctaggtaaatgcaaaaaataaaggaaatcagtatattgaagagatatctacactcccatgtttattacagcactattcacaatggccaagatttggaatcaacgtaagggtccatcaacagatgaatggataaaaagaaatatgtaataaaatagagagtatatctactccatacacacaatggagtactattgagccataaaaaagaatgaggtagatatttccctaagacatatttcctttctactatatattcttttttttttttttttttgagatggagtctcactctgtcacccaggctggagtgcagtggcgaaatcttggctcactgcaagctctgcctcacgggttcacactattctgcctcagcctcccgagtagctgggactacaggtgcccgccaccatgcacggctaattttttgtatttttagtagagatgaggtttcaccgtgttagccaggatggtctcgatctcctgacctcgtgatccgcccgcctcagcctcccaaagtgctgggattacaggcatgagccactgcgcccgaccactctactatatattcttgtgcaagtagatttccatttgtacaactttaatttcaatgtaacaaacatttattaagcactgaaatgtgccaagcattgttctaagctctgaaaaagtgcttcttggctcaggattcataccagactctcctggaaagtattagaataacgattcctgggctccacgaccagaggctgtaatctaataaatccgggataggactcaggaatccacactttttttttttttttttttttttgagatggtatctcactctgtcaaccaggctggaagtacagtggcacaatcttggctcacagcaacctccgccttctgggttcaagtgattctcctgcctcagcctcccaagtagctgggactacaggtacatgtccccatgcccgggtaagttttgtatctttagtagagacgtggtttcactgtgttggccaggctgttctcaaactcctgacctcaagtgatttgtctgcctcagcctcccaaagtgctaggaatttacaggcatgagctaccgcacccggccaggaatgcttttttttttttttttttttttttgagatggagtttcgctcttgttgcccaggctggagtgcaatggcacaatcttggctcaccacaacctccacctcccgggttcaagccattctcctgcctcagcctcccgagtagctgggattacaagaatgtgccaccacgcccaactaattttgtatttttagtagagatggggtttctccatgttggtcaggctggtctcgaactccccaccttaggtgatccacccgcctctgcctcccaaagtgctgggattacaggcgtgagccaccgtacccagctggaatccatatttttaataaagtctgttgcacagttaaggagaacctaaacattgttttccattttacagatgtcttatgtctgagctgtatttacttacaacactttgacaccgaatgtacaggtttttttccatatcaacaaccagttctgtccagctaccaactgggagtctcacaattgaattcttatattaattacccagagttagcacagatcctacaggttaatggctcagtcccacaagactgtcccctacttcagataccagttgcaaatcccagccacctatactcctgaccaaccagctataaatcggagattcccatgaccccttcctcgtgtttgataatttgctagaatgacatacagaacacaggaaaagagtttacttactattactgctttataaaggatacaactcaggaactcaggaagagacatatagggcaaggtatgggggaaggggcacagaacttccaaaccttcctccaggcatacagctctaccagaacctctatgtgttgaccatcccagaagctctatgaactctgttgtttacaaggttttatggaggtttcattaagtaggcatggctgattaaatctctggccacttgtgattagctcaattttcagccccttgcccctccctggaggttagagagcagacttgaaagttccaattctctaattattccttggtctttctggttaacagaccccagcctgaagctatccaggggccctcagaccccagtcatctcattatcataaaagatacttaccggtcaagaaatcccaagggctttaggaactgtgtgccaggaaccaaggatagagaccaaatgcttatttattatcacagtatgacatgaaagacccttaatgacctgacctctgtcttaccggcctcttcttttgcaccaaccatgctgcccaccttccattgcagtaatagtcaatgacttgtaattgcctgaaaatgctagacgtttcactgatacttctgcacattgtctaccctaccagctctacccttacatacacacacacacacacacacacacacacacacacacacacacccctaactttgctagccttttttctgttcatccttcaaattctagttcaaacatctccaagaccttattggacccttaacagaactcattgagcccaccataataataattagtactgttgtgagtattagaaataatgttaagcacctgtgacacaatgtttggctagacactaacatatcctatgggtaacaagaaccctctgaagtagtgtcatgagatgaagatgtggagaaaggggaaacctcgtacactgttggtaggaatataaattagtactgccactacggaaagcagtatgaaacctcttcaaaaaactaaaaatagagcttccatataacccagcaattccactactgggtatatatccaaaagaaaggaaatcaacatatcaaagagatatctgcactccatatttactgcagcactattcacaacagccaaaatttagaatcaggccaggcgaggtagctcatgtctgtaatcccagcactttgggaggccgaggagggtagatcacctaaggtccagagttcgagaccagcctggccaacatggcgaaaccgtgtctctacaaaaaatacaaaaattagctgggtgtggtggtgtacgtctgtagtcccatctacttgggaggctgacgtgggaggatcacttgagcccagggaggttgaagctgcagtgagccgtgatcatgccactgtactccagcctgggtgacagagaccctgtcacagaaaaaaaaaaaaaagaaaaaaagatttgcaatgacatgagaaagtgttgttatatggggaaaaaaagcagaaagcagagctgtatattcattataatatcatctatatgtatatttttaatgacatttatccttaagtggtaaaaaatacagaaaggaaatatataaaatatgaatagtgattactatggaatgattgtattcctcagtgtttctatttttttaaatactttttgaggctgggcgcggtggctgacgcctgtaatcccagcactttgggaggccaaggcaggcggccctgcctaggcaacagggcgaaaccccgtctctactaaaaatacaaaaattagctgggaatagtggcgggcacctgtaatctcagctacttagtaggctgaggcacgagaatcgcttgaacccgggaggcggaggcagtgagccaagatcatgccactgtactccagcctgggcgacacagcaagactctatctggaaaaaaaaacttcttggatttcctacttttctaataataaacctacattacttctaataatttaacaatataaagtagtaaatgcaaacttcatttgtaaatttatgctaacagaaagaaaagagggggaaatgcatgcattacacttgaaataataaaagtaataaacactgtcaagcagctgtaccgagccttacttacaacattcataatttcatttccacaattagctaagtttatagaatgcactccagagactaaaatacatatatggccacagacagctcctgttttctgaatggaaagaaggggaggatgggagatggaaagaggaaactagttccctcagcaaaggagtaccaagttgcagatctcataatgaccttctctgtctactcactacaaaggcaccatggcaactgggaacctcagaatatcaaggaaggagcactgaaagtagaaagtttggagagctattaggggaagggaagaagctcaggaaagctaaatgaaaaatgctaagaaagtcaatacataagaacactctcaaactatccataagcaaagccttaatataaacaaaaccagagccaatttccttatttcccatgtcaaagcttgatagtgatgaaccaatagataggaagcaggaataaaatttcctgcactttcttttctttttttctgtttttgagatggagtcttgctctgttgctcaggctggagtgcagtgcagtggcgtgctgtcagctcactgcaacctccacctcccgggttcaagcaattcttatgcttcagcctcccaagtagttgggattacaggtgctcgccaccacctggctaatgtttgtatttttagtagagacaaggtttcgccatgttggccaggctggttttgaactcctcacctcaggagatccacctgccttggcctcccaaagtgctgggattacaggcgtgagccaccgcgcctggcctcctgcattttcaatagtggttattctcaacgtttgaattataatattgatagtatatatttgccatcatcaaaaggctttcagacctaaatttccaagttttaagcactaacatgcaaaagacttaaagaggtttttccagtaaaaaatttttatcttataaaaggactccttgataataaataatgtattataccaatatggcacattttactattccaaaagtttcatagctattacttaactctatctctaccactagatttaaataaagtcatttcaaactcaaggagtttaaagtgagactaaaaagaaatgagaatctgtatgtctttcctagtcaaacacaaacatatatagctaaaactaaaaagctctgtcataaatggtacataaaatgattataaaattcattaaaatatcatcattaatgcaattaataccaattgttgctctgtaactataaaaagtgtagaatggtaaatcttcctttatttttccttctgtttctctatatgctaccaaattttcactagcaatcatatactttcatgatttgctaacttcctcttaaacgagtcactagtcactgtcataaaaaaaggtggggggtggtaatgtgatagaatgtgacagattaagaaatttaaagaacataatacacaatttgtggattggatacttgcatgaaggaaccagaattttcaggttccttggagaaatgaatagagtgtgtatattaaattagattaaaatttattgaaatagaaagtgaatttttttgactaaaaaaagcagattataaaacagtgtgtacagtatgacctcattttagtaaaaaaatatgaatatatacatatatgcatagaaaaggatacagatggtagggagtaacctttgggtggcaaatatacaagcgtttatgtttgcttgcttgtgttgttttttattttctattctgcttctttaataaagcatgatttaaaaaatattttttctaggctgggcacggtagctcacacctgtaatcccagcactttgacaggtcaaagtgggaggaccacttgagcccaggagttcaagaccaccctgggcaacgtggtgagaccccatctctacaaaaaaatttaggccaggcgctgtggctcacgcctgtaatcccagcattttgggaggccaaggtgggtggatcacgatgtcaggagttcaaaaccagcctggccaagatggtgaaaccctgtctctactaaaaatacaaaaaattagctgggggtggtggcaggcccctgtaatcccagctactcaggaggctgaggcagagaattgcttgaacttgggaggcagagattgcagtgagccaagatcatgccactgcactccagccttggcaacagagtgagactccatctcaaaaaataaataaataaataaataaacttagctgggaatggtggcacatacctgtagtcccaactactcagggactgagcaagaggattgcttgagcccaggagtctgaaggtacagtgagccatgatcacaccactgcactccagcctggacaacagagagaaaccctgtctgtaaaaaaaatttttcaagtatatataaatatatattttctaacttctatccctttctaacaaggctaacatttaattagagaagaactgctcaacagaccataaggcctgggcgcagtggctcacgcctgtaatcctagcactttgggaggctgaggtgggtagatcacctgaggtcaggagttcgagaccagctggccaacatggcgaaaccctgtctctactaaaaaaacaaaaattagccaggcatggtggcgcacacctgttgtcccagctacatgggagcctgaggcaggaaaatagcttgaacctgggaggcagaggttgcagtgagccgagatcacaccactgtattccagcctgggcgacagagcgagacttcatctcaaaaaaaaaaaagcatatctgttacaccaaaggttttagtttagtgtagtagtttatagtacgagctctgactagattcaatacccaagctggccaccttgggcatgttatttaatttatgtctcaattccccatccataaattgtgggcaataggccaggcacggtggctcctgcctgtaatcccagcactttgggaagccgaggcaggtggatcacctgaggtcaggggttcgagaccagcctgagcaatatggtgaaaccctgtctctactaaaaatatgaaaattagccaggcatgatggcgggcacctgtaatcccagctacttgggaggctgaggctagaggattgcttgaacctgggaggcagaggttgcagtgagccgagatcacgccatcacactccagcctgggcaacagagtgagactccatctcaaaaaaaaaagaaaaaaaaaaattgtgggaaataatagcacaatacttacctcatgggattgttttgataattcagtgtggtactccacataaagcacagcagagtatccggcatacagtaaagcacttattaaatgtaacctattattaccattatttttctaattagccactgagaaaacttgactaatatttcctaaagttaatgtgaaaaatagaatgtaggaacaatagataggccttctctcactattgtcctctaaacttctcttttgacccaatggaagaagttgaaagtcaatcccagatcctcccagaatctgaccttgacactattactgcccaaggataaaggtctgcacagctttatatgaattgtgaatgaaaatgaaatctggctgggcgtggtggctcacacctgtaatcccagcactttgggaggccaaggcaggtggatcacgaggtcaggagttcaagaccagcctgaccaacatggtgtctctactaaaactacaaaacgtggccgggtgcggtggctcacgtctgtaatctcagcactttgggaggctgaggcgggcggatcatgaggtcaggagatcgataccatcctggctaacacagagaaaccccgtctctactaaaaatacaaaaattagccaggcgtggcggcatgtgcctgtagtcccagctgctggggagggtgaggcaggagaatggcgtgaacccaggaggcggagcttgcagtgagccgagattgcgccactgccctccagcctgggcgacagagcgagactccatctcaaaaaaataaataaataaataattaaaaaaaaatacaaatacaaaaattagccgggcatggtggtgcacacctgttatcccagctactcaggaggctgaggcaggagaatcacttgaacccaggaggcggaggttgcagtaagccgagatcgtgccactgcacccagcctgggcgacagagcaagactccatctcaaaaaaaaaaaaaaaaatgaaatgtggtatctaggagcttattccaaactcattaacatactatgactagtatcatgggagaaactttacaaattatttataattacaaaagagctcaaaattttctagttaaattattctgaagagtccaacatctttacaggcaatctcatctgaattctcaattttcaaaaatattggtaaagtacttttctttctagatcagaaaagaaatagaaatataactcaacttcagagcccttcctgagtgaatatactttctccttccaaagcaacaactattgtcttgaaccccagtgatagacatcttacgctggttttaggtatacacatataacagcaaatacagattgttctcagataaagttgttaaccaaacatgcttcattttatgttaaccataaaatgaagatcattcagtgacttgaacatatgttttaagacacatgagagaaaattgagatcaagtttcaaatactattgatatgggaaggggacagggaagtgctgggtagagaagggcagagtccctgtcaagggctccacctttgacctgtacctatggacctaagtgagaacaggcatgcctgtttttgcatccaaatgcttcattttccaagaccactctggcctgcaacacccccaatcctgtgcccaaataaacccgagaccacagcaggcacagacacaagtgattgaacatcaagaggagcagaggaacagaccagcagacaccagcaggccagcagacttgcaatggtggaacgacaaggcagagaaagagaggagggacgtctggacaccgaggggaattcaactcggggccgtcagagaagagtccggcctccaggagccctgattcctggggaagaccacctccctactccagcccctccttccagctccccatccatgtcgctgagagccacttccaccactcaataaaaccttgcactcatccttcgagcccacatgtgatccaatttttctggtacactgggcaagagctcaggatacagaaagctgtcacactggccctctgcccttgcaataaggcagatggtctattgagctggttaacacaagctgtctgcagacagcaaagctgaaagagcacactgtaacacatgctcacttgggctttcagagtcgcagacaccaccccaagatggtgccgtggggctggagcccaaaagtgcttcccatggctgttgcacctgcccatctgcatcctccccttaggggtttgagcagtggggcaaccgaaggagcaagcaagacacatccctgtggtacatcctgcaagggagatgagggaactctcctgtttcactataacatgaagtatacactgggcaaggtagctcacacctgtcatcccagcacttgggaaggccaaggccagacaatcacttgaggccaggaattcaagaccaaccagggcaacatagcaagaccccatctctaaaaaaattttaaaaattagctcagcacggtggtgcacacctataatctccactactcaggaggctgaagcaggaggattgtttgagcccaggagttggaagttagtgagctatgattgcgccactgaacacttcagcctgggtgacagagtgagaccaaacaaacaaacaaaaaacccatacatttagcataggataaaaaagatttaaagaaatcacactatgctagagaggaaggaggtggatttttaaaaaagaggaaagaaatcacactatgctaagaggtaaaagacccaaatgtggagataacctgttccaactgtacttcaaccagaaattcagcttattagttgacaaactgtttacagttctatttggttgatagcatgcggtgaattttaagtatgcaaaacgatctgacctcaagtgacatcccataggagcagagaaactgccaatatccatacaactagatggctctgttatatgccaccaaatcatacactggttatcaaaattaagatgtccactggccgggcgcctgtaatcccagcactttgggaggccaaggcgggtggatcacctgaggtcaggggttcaagaccagcctggccaacatggtgaaaccccatctctactaaaaatgcaaaaaattagctgggcacagtggctcacacctgtaatctcagcactttgggaggccgaggtgggcagatcacctgaggtcgggaattcaagaccagcctgacctacatggagaaaccccatctctactacaaatacaaaattagccagacgtggtggcgcatgcctgtagtcccagctactggggaggctgaggcaggagaatcacatgaacctgggaggcggaagttgcagtgagccgagattgcgccactgcactctggcctgggcaacaagagcgaaactctgtctcaaaaaaattaataaataagccaggtgtggtggctcacgcccacccatactcccagcactttgggaggctgaggcgggcggatcacgtgaggtcgggagtttgagaccagcctgaccaacatggagaaaccccatctctactaaaaaatacaaaattagccaggcatggtggcacacgcctgtaatcccagctacttgggaggctgaggcaggagaatcacttgaacccgggaggcagaggttgcagtgagctgagatcatgccactgcactccagcctgggcaacaagagtgaaactccatctcaaaaaaaaaaaaaaatttgccaggcatggtggcgcatacctgtagtcccagctactcgagaggctgaggcaggagaattgcttgaacccgggaggcggaggttgtggtgagccgagatggcaccattgcactccagcctggggaacaacagtgaaactccaactcaaaaaaaaaaaaaaaattaaattaaaaaaataaatgaataaataagtaaaataaaataaaatacaaaaaattagccaggcatggtgggctgggcacagtggctcacacctgtaacccagcactttgggaggctgaggcaggcagatcacaaggtcaggagttcgagacctgcctgacgaacacggtgaaaccctgtctctgctaaaaatacaaaaattagccgggcatggtggcgcgcacctctaatcccagctactcagggggctgaggcaggagaatcgcttgaacccaggaggcggaggttgcagtgagccaagatggcgccactgcactctagcctggggacagagcgagactccctctcaaaaaaaaaaaaaaaaattagtgcggcatggtggagagcacctgtaatcgcagctacttgggaggctaagggaggagaattgcttgaaaccaggaagcagaggttgcagtgagccaagatcgcgccattgcactccagcctgtacaacaagagtgaaactcagtctcaaaaaaaaaaaaaaagtccacattcagcctttcttcttaaatgttcaattgaatactagtgagttccagaaatatatcaacctggctgatatatcaacctctagctgatcatatctaaaaataaaaagccaaatcagttgtctacaatgaggtctgtatattcccaccaagctataactactttttacttagggtcttattttcttttctttctttttttttttttttttttttttttttgctctgttgcccaggcgggagtgcaatggcatgatctcggctcaccgcaacctctgcacccccggattcaagcacttctcctgcctcagcctctcgactggctggaactacaggcatgtgccatcgtgctcggctaattttgtatttttagtagagatggggtttctccatgttggtcaggctggtcttgaactgctgacttcaggtgatccacccaccttggcttcctaaagtgctgggattgcaggcgtgagccaccacgcccagccagggtcttattttcaaatgtttgggtcataaagcttagaaagtgattcatccagctgggcatggtggctcacacctgtaatcctagcactttggaaggctgaggcaggcggattgcctgagatcaggagttcaagaccagcctggccaatatggtgaaaccccatctctactaaaatacaaaaaaattagccgggcatggtggcacacacctccagtactagctgctcaggaggctgaggcacaagaatatcttgaacctgggaggcggaggttgcagtgggctgagattgcaccactgtaattcagcctgggtgaaagagcaagactgtctcaaaaaaaaaaaaaaaaaaaaatggccagggtcaggcataggctgacaggcacagattacaggctcatgcctgtaatctcagcactttgggaggccaaggcaggtggatcacctgaggttgggagttcgagtctagcctaacatggagaaaccctgtctctactaaaaacacaaaatcagcctggcgtggtggcgtatgcctgtaatcccagctactcaggaggctgaggcaggagaatctcttgaacccgggaggcagaggttgcggtaagtggagattgcaccattacactccagcctgggtaacaagagcgaaactccgtctcaaaagaaaaaaaaaaaaggctgggcatgctggctcacgcctgtaatcccagcaatttgggaggctgaggcgggcagatcacctgaggtcaggagttcgagaccagtctggccaacacggtgaaaccctgtctctactaaaaatacaaaacagccgggcatggtagcgggtgcctgtaatctcagctacttgggaggctgaggcaggagaattgcttgaacctgggaagtgaaggttgcagtgagccgagatggtaccactgcactccagcctgggcgacagagcgagtctccctctaaaaaaaaaaaagaaagaaagaaaaaagaaagtgattcacccagtctttcattggactctagaaaatacatggggcaaatcatctccatcgcaggaaaagtctattttctatttgggctcatccatcataccactagacttctcagcacctaaacttgagagagagactcagtcccatcttacattatggcaattacttcatttggtttcagatgacctccagttaacatctcctaggaatgtacctgcccccttaatctatgtcacccatgaaggattaggctattcgttctaagagctgatcctaaactcaacttagtctctatttaactttgagttccaggagtgaaaaggagcatctgaatcaatatcttcatttttatagatgactccaaggagataatatgtactgtccatggtcacacacctaattagtggcagatgtcataacagaggtctttcacctatcaaatgaatttgactcaattaaaattaccccaaaggtcaccatatccagaagtgacttaaggaatggataaacagaaaacgttttttctattttagaacattagctagctgaggagtgagttggaactggcattgtctcctttccatgctgctgatcacacttcaatccatggctcctccacgagctacggacatgatttttgcaacagtaaggcatgcaaagaaattccagacactcatgccactgaccacatagactttgcataagaaccatcaactttgggaatgacttggcaactacaaactgccttgtgatatcactagctgagtttcttataacacatttatctcaccatagccaaactcagtttcctaatccagcaaatggatattatgtttcacatagactcaaactggacagatttctcaaggtgctgtgtggttttatggatttagagttaaaccagtctttctcaacaggggcactacgacattttgagtagcagatttcttggttgtgtaggattatctactataccacagaaggtttagtatcattggtcctttgtcctttgtccgataaatgcaagtagtcctgccagtcacaaccccccaacacacttccaaatgacctcaagagagaagaatgccaccactagtattaaccttagagccaatcattaagtgaactataaaataaaaaatgtttacataaagacctaatcccttttccctgccactaaaatactgctctctattcctctttttaacccagagataatgctttgttcactaactccataaaaccaactttgtctgaactagttatataattaagacacctgtatggacgggaaagtagagtagaaaagttagtgaaataaaatcaggatatgagtttgaatccaagttctctggctattcaaacttaggcaagttatttctcctcattgggccttagttttcccaactatcaaaaagtattttgtggccaggtgtggtggctcatgcctgtaatcccagcactttggcaggccatgataggaggatcgcttgaggccaggagttcaagaccagcctgggcaacatagcaagacctctgtctctatttaaataatgttttaaattaattttttaaaataaaataaaataaaaagtgttaggctaaattatctctctggtttattacaattctaggaacctgtgaagtaaaacataattaacttgctttacacttttcttttgacctctacatagctaaatgagggtgaccactaacgaacactgcctagtctctcagaagccccgatcccaagccccagggataacagtaagacagaacaatcacatccagccagatctcatacaggattttattatagagttgatatatttagtgtataaaatagagctgaattattttatgacccattaataataaaggtgccaagatagtaacagcaacaacagccaccctaacttatgttatctagggtacacctataatctgaatgctggctgtacacaacaatcacctggataccttaaaaaaaagccccagttccacaccaagccagtatcaaatgaatcgaaatctctggggatggggcttatctcccaaggctccccgaggtgattctgatgaacagtgagaaccaagaaccactgatccagaccttttaatccaagaactgaaaagtaaatgaccaaaggttagtatctcacacgctagttatataatcaaacatcgataaataaaaacaatctagtgttactatgtactgacattctcagttagggagaactgtgtttctagagaaaaaggagagctctattaacagccctttattggggactggccctgctagaaacagaatataacttcctgacaatctgatgaattagttcaaaaaaacttactacgaagttgacaacacctggagaagtcctatcaatcatcaagatagttagaacaatgttagtcaaagtagtacaaaaactgatgttcctcaacctaactcttactcactaggtctcactgaaagacctagcaggtagaagtggccaggtgtagtggttcatatctttaatcccagcactttgagagactgaggcaggcggatcacttgaggtcaggaattcgagaccagcctggccaacatggcgaaacccggtgtctatcaaaaacaacagaaatcagctaggcgcaagggcatgcacttgtagtcccagctattcaggaggctgaggcaggagaatctcttgaacctgggaggcagaggttgcagtgagctgagattgtaccactgcactcccatttgggcgacagagtgagactctatctcaaaaaaaaaaaaaaaaaataggctgggcggggtagctcacacctctaatcccagcattttggaaagctgaggtgggcggatcacaaggtcaggagttcaagaccagcctggccaacatggtgaaactccatctctactaaaaacacaaaaaattagctgggcatggtggcaggcgcctgtaatcccagctacttgggaggctgaggcagaagaattgcttgaacccaggaggcggaggttgcagtgagctgagaccgcaccactgcactccagcttgggcaacaaagcaagactccgtctcaaaaaacaaaaacaaaaacaaaaaaaacctagtaggacatgaaaaatttgatgggaacatacatgatttctgaaaaatacatcatttctgacttcctcaacaaagctttgagttcagtgacataggaaaaggcaaagcagtcttagctgaaatcatccttgctcttttcagaacataatcagcaaaactaacaagacagattaaataagtagaccattgaactctctcttaccttatgtgcaaggccaagccatcctgtaggctagagatccccaaatcagagagtgtatctgagccaacagaagcaggtgacaaggagccctccttctcctccagtaggtccaacttcaccaggttgctgatctcatcctctgagttatcttcagacacagaacctattatgaatcgagagtgctggttcagctccagaggttgggccaagggagatggttcatccattattcctccaaaatgagctcttacagctatggagaaaatgaaaagtgagaaaggcaggttatgaataataatctatatctgaggtcagccagaggttatatctaataaaccatagctgagacgtggaagcaaggcaatttgagaactaacttccttggctattctatttcagggcctttaatttctacaagggaggaaaattgagatcatgataactatgcccataaattaaaaccagttcccttttcctcaaagaaatttttctcaaaagcctataaggcattcctaatctcattttcatttggtggtgtccaggaaataattatgatcaatggggaaacctttgcagtaggaaaaagctgcttgttgtgatattgatattttggttgttagtaatgggggaataaatggtaagggtctggatagagtaatggttgtttgaaataatatttaaactacataatgctcatctggcttcaaacactatatattgagaggctataacttttattttattatttatttatttgagacagggtctcactctgtcacccatacagcatgcagtactacaatcatggttcactgcagcctcaaactctttgggctcaagtgatcctcctacctcagcctccccagtagctgggactataggcacgtgccaccatgcccggctaattctatttttatttttcatttatttatttatttatttatttatttatttatttatttagagacggagtctcgctctgttgcccaggctggagtgcagtggtgcgactgccactcactgcaagctccgcctcccgggttcatgtcattctcctgcctcagcctcctgagtacctgggactacaggcacccgccacaacacccagctaattttttgtatttttagtagagatggggtttcaccgtgttagccaggatggtctcgatctcctgaccttccgcctcagcctcccaaagtgctgggattccaggtgtgagccaccgcacccggcctattttttttttcttttttgagacgtagtctcactctgtcgcccaggctggagtgcaatggcacgatctcagctcactgcaacctccgcctcccgggttcaagcaattctctgcctcggcctcccaagtagctgggattacaggtacccaccaccatgcccggctgacttttgtatttttagtagagatggagtttcactatcttggctaggctggtcttgaactcctgatctcatgatccacccacctcagcctctcaaagtgctaggactatgggtgtgagccactgtgcccggtctaatttttaaatattttgtagaaatggggactccctatgttgcctaggctggtcttgaactcctgggctcaagcaatcctctcaccttaggctcccaaactgctgggattacaggtgtaagccactgtgcctggcctatgaattttacgtatgtgtatacttttaaaacaaactccagataggtaatttttaattaaaaaaaaaaaaactttacttgtcctcatgagttttttcttaaattatgcattttaaaatgtcaccccaaaatgactacttttggctctaatgtgctgacactgatatgagaagaaaatgaatctatcaccaaatttaaaatctataatcacctcaagtaagtataatttttctaaatgtagggccttaccagttaggattagatactgccaatagctaactaagaaactaattaacagcaaaccatcatgacacgtgtttacctacataacaaacctgcatgttctgcacatgtatcccagaacttaaaagtataatttaaaaaaaaaaaagaaagaaaaagaaactaattaataaagaccaaaacagcaacattcattctcttttatggaatgaagtgctgcccataaaaatttaaaaatattttttaaaaaccaaaataagagcccacaacaataaaaacccaaactaaatgaaacaatatttcttctgtcatctcaaaaatcctattttaaaatttcaaaactacagatcaactcagtattaaatagcttgtacccagatcaattattttaattcagaaaataagcctgggcgcggtggctcacgcctataatcctaacaacttgggaggcagaggcaggaggattgtttgagtccaggagttcaagactagcatgagcatcaaaacaagatcccatctgtacaaaaaaaaaaaaaaaaagattggccggacgcggtggctcacgcctgtaaataccagcactttggtaggccgaggtgggtagatcacctgaggtcagcagttcaacaccaacctggccaacatggtgaaaccccgtctctactaaaaatacaaaaattagctgggtgtggtaacaagtgtataatcccagctactcgggaggctgaggcagaagaatcacttgaacccgggaggcggaggttgcagtgagctgagatcatgcctctgcactccagcctgggtgacagagtgagactctgtctagaaaaaaaaaaaaaaaaaaagattaataattcccaattgtggaccttttagaggttcccttgactgatcccgacctcaacttgtatactgatggaagttcctttgtagaaaaaggactttgaaaagtggggtatgcagtggtcagtgataatggaatacttgaaagtaatgccctcactccagcaactactgctcagctggcagaactcatagccctcactcaggcactagaattaggagaaggaaaaaggataaatatatatacagactctaagtatgcttacctagtcctccatgcccatgcagcaatatggagagaaagggaattcctaacttccaaggaacacctatcaaacatcgggaagccatcaggagattattctaggctgtacagaaacctaaagaggtggcagtcttacactgccggtgtcatcagaaaggaaaggaaaggaaagggaaatagaagggaaccgccaaccagatattggagccaaaagagccgcaaggcaggaccctccattagaaatgcttatagaaggacacctagtatggggtaatcccctccaggaaaccaagccccagtactcagaagaagaaatagaatggggaacctcacggggacatagtttcctcccctcaggatggctagccaccaaagaaggaaaaatacttttgcctgcagctaaccaatggaaattacttaaaacccttcaccaaacccttcacttaggtattgatagcacccatcagatggccaaatcattatttactggaccaggccttttcaaaactatcaagcagatagtcagggcctgtgaagtgtgccaaagaaataatcccctgccttatcgccaagctccttcaggagaacaaagaacaggccactacccaagagaagactggcaactagattttacccataggcccaaatctcagggatttcagtatctactagtttgggtagatactttcactggttgggcagaggccttcccctgtaggacagaaaaggcccaagaggtaataaacgttcatgaaataattcccagattcggacttccccaaggcttacagagtgacaatggccctgctttcaaggctacagtaacccaaggagtatcccaggtgttaggtatacaatatcactcacactgcgcctggaggccacagtcctcaggaaaggtggagaaaatgaacaaaacactcaaatgacatctaaaaaagctaatccaggaaacccacctcgcatggcctgctctgttgcctatagccttactaagaatccgaaactctccccaaaaagcaggacttagtccatacaaaatgctgtatggacggcccttcctaaccaatgaacttgggcttgaccgagagacagccaacttagttgcagacatcatctccttagccaaatatcaacaggttcttaaaacattacagggagcctgtccccaagaagagggaaaggaactattccaccctggtgacatggtattagtcaagtcccttccctctaattccccatccctagatacatcctgggaaggaaactacccagccattttatctaccctaacggcagttaaagtggctggagcggagtcttggatacatcacactcaagtcaaaccctggatactgccaaaggaactcaaaaatccatgagacaatgctagctattcctgtgaacctctagaggatctgcgcctgctcttcaaatgacaaccagggggaaagtaactaaaatcgtaaatcccctggccctcccttatcatatttttctctttactgttctcttaccccctttcactctcactgcaccccgtccatgccactgcaccccgtccatgccccgtccatgccagtagctccccttagcaagagtttctatggagaatgcagcgtcccggaaatattgatgccccattgtataggagtttatctaagggaacccccaccttcactgcccacacccatatgccccacaactgctataactctgccactctttgcatgcatgcaaatactcattattggacaggaaaaacgattaatcccagttgtcctggaggacttggaggactcacttcactcataccagtatgtctgatgggggtggagttcaagatcaggcaacagaaaaacacataaaggaagtaatctcccaactgacctgggtacatagcacccctggcccctacaaaggactagatctctcaaaactacatgaaaccctccatacccatactggcctggtaagcctatttaataccaccctgactgggctccatgaggtctcggcccaaaaccctactaactgttggatgtgcctccccctgcactttaggccacacatttcaatccctatacctgaacaatggaacaacttcagcacagaaataaacaccacttctgttttagtaggtcctctttccaatctggaaataacccatacctcaaacctcacctgtgtaaaatttagcaatactatagacacaaccaactcccaatgcatcaggtgggtaactcctcccacacgaatagtctgcctaccctcaggaatattttttgtctgtggtacctcagcctatcattgtttgaatggctcttcagaatctgtgtgcttcctctcattcttagtggcccctatgcccatctacactgaacaagatttatacaatcatgtcatacctaagccccgcaacaaaagagtacccattcttccttttgttattggagcaggagtgctaggcggagtagctactggcattggcggtatcacaacctctactcagttctactacaaactgtctcaagaactaaatggtgacatggaatgggtcgctgataccctggtcaccttgcaagatcaacttaactccctagcagcagtagtccttcaaaatcgaagagctttagacttgctaaccgcggaaagcgggggaacctttttatttttagaggaaaaatgctgttgttatgttaatcaatccggaatcatcaccgagaaagttaaagaaattcaaggtcgaatataacgtagagcaaaggagctgcaaaacactggaccctggggcctcctcagccaatggatgccctggattctccccttcttaggacctctagcagctataatattgttactcctctttggaccctgtatctttaacctccttgttaagtttgtcttttccagaatcgaagcagtaaaactacaaatcgttcttcaaatggatccccagatgcagtccatgagtaaaatctaccacggacccctggaccggcctgctagcccatgctctgatgttaatgacatcaaaggcacccctcccgaggaaatctcaactgcacaacctctactacgccccaattcagcaggaagcagttagagtggttgttggccaacctccccaacagcagttgggttttcctgttgagaggggggactgagagacaggaataactagatttcctagaccaactaagaatccctaagactagctgggaaggtgaccgcttccacctttaaacaccgggcttgcaacttagctcacgcccaaccaatcagatactaaagagagctcactaaaatgctaattaggcaaaaacaggagataaagaaatagccaatcatctgttgcctgacagcacagcaggagggacaatgatcgggatataaacccaggcattcgagccagctacagctaccctctttgggtcccctccctttgtatgggagctctgtcttcactctattaaatcttgcaactgcaaaaataaaaatagaaaaataataattcccaattgtgattttgaagtgctctaagatatggtacattaatagataataaatgtattattaataactctgtatgctataactcactgtaaagtatgaaagtaagtggacaacagtgttccttgacatcagatgagaaaccgtcaatactttaaaatgtttgggaatcaccactcaacatgtgaaaattacatatgcacgattgttctggtgtaatttgtgagtcagtttactcacttacagagacaaacagcatttataaatgctagagtagtgtggttctcaaagtgtggtccctggaccattggcatcacctgggaacttgttagaagtgcaaatttcttgggcccttccccagaccaactaaccatatcagaacctacaggccagcatccattcatctatgctttcacaagccctaaaggttgagaatcactgtggtacaagaataaaacagtaattaacaaattggcaagactgctaaaacaaaactaaagaaaacctataccagcctgggcactatagtgagatcccatccctaaaaaaaaattttttttaattagctgcatgtggtggcatgcacctgtagtcccagctactggggaggctgaggtgggagaatcgtttgagcccaggagttcaagactgcagtatgctgtgatagcaccactgtactccagccttggtgacagagcaggaccctgtctcaaaaaaaaaaaaaaaaaagaaaagtaaagaaaactatagacatttcccttttttttagaggcagggtcttgctctgtcactcaggctagagtgcagtggcacgatcctcgttcactgcagcctcaaactcctgggctcaagcatcctccaacctcaacctccaaaatagctgggactacaggcatgcatcactatgcctggctactttttgtttttttgtacagacagcatctccacatgttgcccagcctagtctcaaactcctgagctcaagtgatcctcccaccttggcctcccaaacggttgggattatcagtgtgagccactgagcccagcctaacattttctgaaagtgaactggagattactttagctaacttctatctttaaaactagaatcagctgggcgcagtggctcacgcctgtaatcccagcactttgggaggccaaggtaggtggatcacaaggtcaggagatcaagaccatcctggctaacatggtgaaaccccatctctaataaatatacaaaaaattagccgggcgtagtggcgggcacctgtagtcccagctactcgagaggctgaggcaggagtatggcgtgaacccagggggcggagcttgcagtgagcagagatcacgccactgcactccagcctgggcaacagagtgagactccgtctcaaaaataaaataaaataaaataaaataaaataaaataaaacaaaactagaatcaaatataaaagtatgatgcaacatgagccaagatcaccactgcactccagcctggtgacagagcgagactccgtctcaaaaaaaaaaaaaaaaaaagtatcatgcaacaaaaaaaatttgctgtctaaatttactatacatttctcccttgaaatattaggtcttaaaaaaagttcaagatcagcctgcccaacatggggaaaccccatctctactaaaaatacaggccaggcacagtggctcatgcctgtaatcccagcactttgggaggccgaggcaggtagatcacctgaggtcaggagtttgagaccagcctggccaacacagtgaaaccccatctctactaaaaatacaaaaattagccgagcgtggcgcatgcctgtaatcccagctactcaggaggctgaggtaaggagaatcgcttgaacctgggaggtgacagagcgagactctgtctcaaaaaacaaaaaaaaacaaaaaacctttaaagggctcccattatttttggccaggcacagtcgctaatgcctgtaatacccagcactttgggaggccaaggtgagcggatcacctgagatcaggagttcaagaccagcctggccaacatggtgaaaccccaactttactaaaaatacaaaaaattagccaggcgtggcggtgggcacctgtaatcccagctacttgggaggctgaggcatgagaattgcttgaacccaggaggcagaggttgcagtgtgccgagattgcgccactgcactctagcctgggtgacagagactccctccgtctcaaaagaaaaaaaaaaaggaagaaaaaaggcagagagggagggaaaaggggaaaagggagggaaaaggggtaaaagggagggaaaaagaaagaaagggggagggaagggaaagttccaacagactgaccacactgaagaacaccaaaagttacagcagcaaaaagcctatttctttcacatttacagcagtaaatagttaagtttaaaagtaacagtagatccaaaaaataaaatcccatcccaactaacagaagataatgggtgccttcttcacaaagtaagaaagcaaggcactcaggtgcagattctagcttgcagtctgactgaagttagatgaccacacacaaaagagaaaatccacaaggcacaattctttgactccatgggagaagaaaaagagagttaataaaacacggttcctgggctaataagtgagagtctcaataaggccaacttcaagttcctagctaagaagaccatgaaggcagctttcactaaacggttacatagattggaggcaactcagtgtgaacagctaaaaagcctgtccagcaactgtactgaatagtatttcccaggcacgagcctacaaaccaacagaaaagagaggtcatgtatggaaaattactgagtagctgtccagacactctagaagctactccacagcctgtcccatttccactgattctagtcctgaattaaagagagaatacagttgagtaccattgttagactctttgttcacttcaggttatccaccctaaatctgcctatattattttgtggaagtcaacttttaacacaaaagcctacagtttgatattttacaacatgaacaaaatttttatcacattgtaaacaaggagtattatttgtaactgacctcttataattcttactgtctgagtagatatccacttccagaaagacctagagagaaaaagagagaaagattttaaggtttttttttttaagaaacaaacttttgtcaattcctgttttgctcagcataatacaaaggtaataatatatgaagtatctattttactggtcaaatctattatttaacttaaagcacaaagtttagcagtttattatttgttcaattctgtaaatcaaacacattacataaagactattgtttaagaaaatattaaacaatagaacaagcttaccatttcacaaggtggcttttccaattgtatactccatgaatacatttcaaaattttcatttctaatatttcatcaaaaaagaggcagtggggagaagagaaccactagattctctacaattcacttaagctctgattatgtttacaagcggttacacctacacacaaagattgggagccaggtggaagacagagtgcccattatactaagtccctaaactgtaagggatcaaacagtctctagcaactccccaaatcctcggtttccttcttaagcctgacaatttaaatctatctagggtagaaattctcaactctgattatgtttaagaatcacctgcggagcttttaaaaattttacaaagtctaaacaccaccctagatctgctgaatcagaattgcagctggagacccagggatatcaactttaagttccacagttaattgacactgatggaaatacacgcttgagaaccactcgttaagggcagagaagaaacaaaaggaaagaacctattacactggtagggaaatctaaaacttccgagaggacccctaaatgacaagggacaacatttaggaatattaggatttatccagttatgcagtctgagctagtattattccctacaactgagaagaggaaggaaaaagtttggatcatgtaaccaaagatgcagtgaaagtggagttaaaacctaggaccaatcaagctcaaactctgactgtcaaatattgcaagtgactgcagacttgaaggtcacttaacgtctctgtatatcatacagacaagcctcctcatctgtaaaaataaaaaagaaagtcttctgggcagtagtgtgcacctacagtcccagctacttgggaggctgaggcagaggtgtgctagagtccaggagctggaggctgcaatgtgctatgaccacacctgtgaaaagccaatgcactccagcctgggcaacatagcaagacccccatctcaaaaataaataaattaacgaatttaattaagtttaaagaaggtcatatgtacctcatgggactgctgtgaaaactaagaatatatgaaaggattttgtaaactataatgcaataggccagtgtttttcaaattatgggttaccacccagcaaaacattaagaaatcaatttagcaagttataaccaatattttgaaaatgaaataagatagaaaatgttaagatataccatagtttatgacagtatccatagttttgtaaatttttgtttcagttatatataggtcatgatgtaaatgacattttattatgaggtatgtcaaaaaaagtcttaaagcggccagatgtggtggctcacacctgtaatcccagcactttgggaggccaagatgggcagatcacctgagatcaggagtcaaaaccagctgggccaacatggtgaaacctcgtctttactaaacatacaaaaattagccaggtgtggtggtgtgtgcctgtaatcccagctactcaggaggctgaggcaggagaatcgcttgaacccgagaggcggaggttgcagtgagccaagatcaccccactgcactgtagcctgggcagcagagcaagactctgtctcaaaaaaaaaaaaaaagccttaaagccacaactaatccttactccctcaccccctccactttataacctcactagacagcaaagacagccagttaagtacataaaccaacgattcttaaaagtgtctcaactgttggaaatttgatgaaagctatggaccttttcttgacaaaaatgtaccctcatacaaaattttcattccatacaggtttgggattcctaaactcctgccctgaattaggttaagacctctttctccagaaagaggactaaaaaagaagctgacctttggggaaggctcatataattgctgtcttagttctgaaacaaggcctttttccagatccagtctgcctactcaaataaaaattattttcttcattatataaaattgttgacaatgccaaattctcttttatttaaaaaatatatcatgtggccaggcgcagtggctcacacctgtaatcccagcactttgggagatgaagacgggcagatcacttaaggttcggagttcgagaacagctggccaacatggtgaaaccccgcctctactaaaactacaaaaattagccaggcatggtggcagacacctgtaatcccagctactggggaggctgaggaaggagaatagcttgaacccaggaagcggacgttgcagtgagccaagaatgcaccactgcgctccaggctgtggacaaagtaagactgtctctcaaaaaaaaaaaaaaaaaaaaaaaaaaaaatatatatatatatatatatacacacacacacacatatttttaaatatatatgtattttaaatacatatatatatcctatatatacactatacatataatgtattattcagcttttatttggagactcttgaaaatttttgcggaaggctcccaaactgtgccttatgttcctgaaaatgtggtaaagctaattacagctaatgtatttaagagtcagcctgggccaggagtggtggctcatgcctgtaatctcagccatttgggaggctgaggtgggagaatcccttgagtccaggagttcaaggccagcctgggcaatatgacgaaaccccatctctaccaaaaaaaaaaaagctggatgtggtagcacatgcccatggtcccagctacttgggaggctgaagtgggaggatcacttgagcccagaaggttgaggctgaagtgccactgtactccagcctggccaacagaatgagactttgtctcaaaaacaaaaacaaaaacaaaaaaagtcagcctgcatttcattcagaaattttttttttctttttattgagacggagtctcaatctgtcacccaggctggagtgcagtggcacgatctcagctcaatgcaacctctgcctcccgagttcaagctattctcctgcctcagccttccgagtagctgggattacagatgcatgccaccacacctggctgatttttgtatttttagtagagacggcgtttcaccatgttggccaggctggtctcaaactcctgatatcaggtgatccacctgcctcagcctcccaaagtgctgggattacaggcgtgagccactgtggccggcccagagatatttttctaaataaatacaacagattttaccaaatttagttagcatattctccttgaactcaaattacactgtattttccatgcaattctaataaagaggcagcaattagttttcatagccactgataaaagtatccaagcttttacaacatgtccttgcctctcaagtcatagtaagttcacttaaatgttttcaaagaggccgggtgcagtggctcatgcctgtaatcccagcactttgggaggccaaggcaggtggatcacgaggtcaggagttcaagaccagcctggtcaagatggtgaaaccccatctctactaaaaatgtaaaaattagccaggcctggtggcgggtgcctgtaatcccagctacttgggaggctgaggcagagaactgcttgaacctagaaggcagaggttgcagtgagccaagattgtaccattgtactccagcctgggtgacagagtgagactctgtctcaaaaaaaaaaaaaaaaaaagttttcaaagacaataagtgaatttgccttgttcactttgtcatttattttttaatggattttggttattaattcagtgattcataaaaggattacagaaaattttattttaaaaactattttaatttaccacaagttttaaattttaaaataacaagaacttgtgttccaaatagtgaaacagatgctgattattcaaagataaataagatttgtccctagctaagtggctattgacacctaaatatacaattacagtagtataataatctctgaaaacacaaaaaatataaacaaaaaaataaaaagataaaaaataaaaaagaaatttaaaaatttttttaaaaagaaaaaaaaacctctaggccaggtgtggtggttcacacctgtaatcccagcattctgggaggctgaggcaagaggatggcttgagcccaggagtttgagaccagcctggacaccatggcgaaaactgtctgaagacagtgggttgggccgggcatggcagctcacacctgtaatcacagcactttgggaggatgagacaggctgattgcttgaggtcaggagttcgagaccagcctggccaacatggtgaaacccagtctctactaaaaacacaaaaattagcggggcgtggtggtgtgcacctataatcccagctacctgggaggctgaggcaggagaatcacttgaacccaggaggcagaggctgcaatgagctgagatcatgccattgcattccagcctgggtgacagagcgagactccttctcaaaaaaataaataaaaataaataaataaataaactaaaaaggcataacccacaaaaagaccaaaaaagaaattaaaaagtctgggtagacaacaagacaattttcttggaaagcagacagaagagcaataaatgactaggcaagcccaagaaaactgaatcatagcccaactgtggtaaacttacgatcaacacaatttatgtcatacgttccccaaaatgttcagaaagtggaggtgaaagagagctaaagaaaataaggaggattggttgaaattgtttccgaagcttcagatcattacattttctccccaactagtgaagtcaggtgcctgctgctctaccatcctgagactttaggtttattctctagagagggttaaacagagggtttctagattgggggataccagcaacagtaaggggcagggtacaatactgaaaataaataaattaagtcaatatattgagtaagattttccggtcctctttccctaatcgtcaccttcccggagagagattagaggatccttcttgcccaggctggagtccagtggcatgatctcggctcaccacaacctctgcctcccaggttcaagagattcttctgcctcagcctcccgagtagctgggactacaggcccgcaccaccattcccggctgatttttgtatttttagcagagacggggtctcaccatattggccaggctggcctcgaactcctgacctcgtgatccacctgcctcggcctcccaaagtgctgggattataggtgtgagccaccgtgcccagcctagaggatccttcttcggagaatctgaccagctcaaggagagaaaaataactaaagttactaacatcaacgtccctaattgagttgcccaaccagattacactgtagtaagctaaccacctctaatcagctttcaacacttcctcttaaatataaacagacaataaagattaccagatgtctgagaaaaacttcaacatgaaagactaaaaacaaataactacctgtagattaaaaaaatgcaacttgaagaaaagagattacagggaacaagaaaccattaaaaactacaggggtcgaggggaggggaaagcaacttcacctctgcggtattttcccaaaaaacccataaccctagtttaatcatgagaaaatatcagacaaatttgaattgagggacattctataaaatacttgatgagtactattcaaaatcatcaagccattacaaaaatggaaagactaagaaactatcacagatcaggggagattaatgagacatgaccactaaatacaatgtggtatcctacattaaatactggaatagaaaaacacatcactaaaaaagaaaagctacagaaggccagcatggtggctcatgcctgtaatctcaacactttgggaagcttaggcaggaggatcacttgaggttaggagtttcacattacaatgagctataatggagcccctgcactctggcctgggcgacagagagggaccctatctctagaggaaaaaaaacccaggaaatacagttttatagtttagttactattgtaccaatgttaatttcatagttttgactaaagtattatggttagccgggcatggaggcatgcacctgtaatctcagctacttgggaggctgaggcaggagaatcacttgaacccaggaggcggaggttgcagtgagccgagatcatgccactgcactccagcctgaccaacagagcaagactctctctcaaaaaaaaaaaaaaaaagtattatggctatgtaagatattaacaattgcctacttgagggtagcagatgggagggaaacgataagaaaaaatatctattgagaccaggcgtggtggctcactcctgtaatcccagcactttgggaggccaaggcaggtaaatcacgaggtcaggagatcgagaccatcctggctaacacggtgaaacccagtctctactaaaaatacaaaaaaattagccgggcgtggtggcgggcgcctgtagtctcagctactcaggaggctgaggcaggagaatggcgtgaacctgaaaggtggagcttgcagtgagccgagatcacaccactgcactccagcctaggcgacagagcaagactccatctaaaaaaaaaaaaagatttgattgccctgctagattatggaattgcatggagcctgtagcccctttgttttggacaatttctcccatttggaatggctacatttacccaatgcctgtatttccattgtatctaggaagtaaataacttgcttttgattttacaggctcataggcagaagggacttgccttgtctcagatgagactctggactgtggacttctgagttaatgctgaaatgagttaagactttgagggactgttgggaaggcatgactggttttgaaatgtgagaacatgagatctgggaagggccagcggctgaatgatatggtctggctgtgtccccacccaaacctcctctttaatttccacgtgttgtgggagggacctggtgggaggtaatcgaatcctgggggtgggtctttcccatgctgttctcgtgttagtgaataagtctcacgagttctgatggttttaaaaacaggagtttccctgcacaagctctctctctgcctgcttccatccatgtaaaacatgacgtgctcctccttgccttccgccatgattgtgaggtctccctggccatatagcacagtaagtgcattaaacctctttcttttgtaaattgtccagtctcgagtatgtctttatcagcagtgtgaaaacagactaatacaagggctcaagtgatcctcctacctcagcctcctgagtagctgggactacgcacacactaccacacccagctagcttttttgtgatttttgtggagacggggttttgttatgttgcccaggctgatctcaacctcctgctcaagcgatcctccagcctcaacttcccaaaatgttaggactgcaggtgtgagtcacaacagctggtctgaaatatttttaaaataactattttaggccaggtgcggcggctcgcacctgtaatcccaacactttggaaggctgaggcaggagggtcgcttgagtccaggagttccagaccagcctgagcaacaaagcataacgccatccctacttacgtaaaaaaaaaaaaaaaaaagaaagaaaaaaaattttttaacaagaaagaatttttaaaagctaaaaatatgatcacagcaatgaaacaactcagaagataaggttaaagaaaagctttcacaaatcagaataaaaagtcaaagagggccaggtgcggtggctcatgcctgtaatcctagcactttgggagggcaaggtgggaggatcacctgaggtcaggagttcaagaccagccttggccaacagggtgaaaccccaactatactaaaaatgcaaaaattagccaggtgtggtgctacacgcctgtaatcccagctacttgggaggctgaggcagcagaactgcttgaacccgggaggcagaggttgcagtacccaacctgggtgactgagtgagactctgtctctcaaaaaaaaaaaaaatatttaaagtgatgaacaacaggagagaaaaagaagatgagagaacctgttcagaaggtccatatctaagtaacagaagctcccaaaagcaagaacaaaacaaagggcaaaaattttaatctgataatcatgccagattgccatggtcattgccagattaaaaaggcccaacaagtgcctaccataatgaataaaaagagacaccaaggcacatcactgaaatttcagaaactgaacacaagaaaagatcctacaagcttcctgagagaaaaaagttcacatacaaatgatcaagaatttgaatgcctttcagacttatcagaaataacaacagaagcttgaaggttattaaacaatgccttcaaaattctgaaggaaaattattttcaatctagaattttagacacaataggttgctgatcaattgtgaggacaggacatattttcagacagcaaaatctcaaaataattacctccgataatgatgcaattagaaaacataattcattttacaaacaccaatgctatacgggcgtggtaattccagcactttgggaggcagagacgggcggatcacgagatcaggagattgagaccacggtgaaaccccgtctctactaaaaatacaaaaaattagccgggggtggtggtgggcacctgtaggcccagatactcaggaggctgaggcaggagaatggcgtgaacccaggaggcagagcttacagtgagccgagatcgcgccactgcactccagcctgggcgacagagtgagactccgtctcaaaaaaaaaaaaaaaacaccaatgcaataactgatgttggcaaatatcgtaaatatatgttaaaactattggataaagggttttcagaaaacaacatattctttattatttattattattattattttttgagatggagtctcgctctgttgcccagatgtgagtgcagtggcgtgatcgccgctcactgcaacctccacctcccagactcaagcaattatcgtgcctcagcctcccaagtaactgggattacaggcgtgtgccccaacacatggctaatttttatatttttagtagagatgaggttttgccacattggccaggctggtctcaaactcctgtcctcaagcaatccatctgcctcagcctcccagagcactgggattacaggcatgagccaccatgctcagtgaaaacaacatattcttacatatatatatatatataaaacatatatataatatatattatatatacatatatcttacatatagataagatatatcttacatatatattttacatatatacgtatataagatatatcttacatatatatatcttacatatgtgtgtgtgtgtgcgcgcgtgtgtgtgtgtatatatatatagcttttttttttttttgagacagagtctcgctctgttgcccaggctggagtgcaatggccagatctcagctcactgcaacctccgcctcccaggttcaaacaattcttctgcctcagcatcccaagtagctgggattacaggtacccaccacttcacccagctagtttttttgtattttcaatagagacaggattgcaccacgttggccaggctggtctcgaacttctgacctcaagtgatccgcctgcctcagcctcccaaagtgctgggattacaggcatgagccactgcacctggccatattcttacatattaattacaaaagggaaaagtatctttacaatggagaaatctgatggataccatcttaactaagtattcaaactaaatatcaccaatattaggaaaaactgacatccttgtatgatgtgtgtgtggtttactctgtgtgtgcatcactggatgtgatgcaatagaagtatacaacaggctaggcacagtggctcacacctgtaatcccaacactttcggaggctgaggcattacgactgctcaggagttcaagaccaggctgggcaacaaagtgagactccgtctctataaaaaataaaaaaattaaaaatttgctaggcataatggcacgtgcctatggtcccagctacacagaaggctgatatgggcggactgcttgattccaggaggtcgaggctgcagtgagccataattgcaccactgtactccagcctgggcaacatagtgaacccgtctcaaaaaaagaaaaaaaaaaccaaaaaaaaaaacccagaaaaaattagctgggtgtggtggcacatgcctgtagtcccagctacttgggacccttaggtgggaagatcacctaagcccaggaggttgaggctgcagtgagccgtgactgtatcactgcattccagcatgggcaaaagagcgagaccctgtctcgaaaacaaaacaatgaacaaacaaaaaaatgtgtttcgggctgggcgtggtggttcgcacctgtaatcctagcactttgggaggccgaggcaggtagatcacctgagattgggagtttgagaacagcctgaccaacatggagaaaccctgtctctactaaaaatacaaaattatccgggcatggtggcgcatgcctgtaatcccagctactcgggaggctgaggcaggagaatcgcttgaacctgggaggcggaggttgtggtgagccaagatcaggccattgtactccaacgtacatggcccccttttgtgcttttaaaatgttgaaccaggccaggtgcagtggcccacgcctgtaatcccaacactctgggaggccgaggtgggcagatcacctgaggtcgggagttccggaccagcgtggccaacatggtaaaaccctgtctctattaaaaatacaaaaattagaggggcgtggtggagcgtggcgcatgcccataatcccagctactcgggaacctgaggcaggagaattgcttgaacctgggaggtggagattgcagtgcgctgagatcgcaccgctgcactccagcctgggcaacaaagcaagattgtctcaaaaataaaataaaataaaatataaaataaaatgttgaaacaggctgggtgcggtggctcacgcctgtaatcccagcactttgggaggccaagaccggaggatcacctgatgtcaggggttcaagaccagcctggccaacatggtaaaaccccatctctactaaaaatacaaaaaattagctgggcatggtggcacacgcctgtaattccagctacatgggaggctgaggcacgagaattgcttgaacccaggaggcagaggttgcagtgagtcaagatcctgccactgcactctagcctggggtgacaaagagtgagactctgtctcaaaaaataaataaacaaataaaataaaatgttgaaccacatgaatgtattgccaactgaagattttaagtaagtttaataaaaagctttcctcaattaattccatgctactctgatcccttatctcatatctgtcagaggatttagccagacaactgaaatgttattcacttatttctttaatatgtgttactatgtaattgactctgggttatctcctagatgaggctgggaaaagttatcctctcttccaaaaacaacaaaaaggagagaaatggaggtcttgctatgttaacgaggctggtcttgtactgctggcctcaagcaatcctcccatcttggcctcccaaagtgctaggattacagatgtgagccaccgtgcccagcctcttctaattgttttagatccaccaccctcaatgcctcacaatgctgtgtaaacaccaggctttcacaggctgcattttttttttttttttttttgagacagagtcttgctctgtcacccaggctggagtgcagcggcgcaatctcggctcactgcaagctccgcctcccgggttcatgccattctcctgcctcagcctcccgagtagctgggactacaggcgcctgccaccacattcgtctttttagtagagacaaggcttcaccatgttacccaggatggtctcgatctcctgaccttgtgatctgcccacctcagcctcccaaagtgctgggattacaggggtgagccaccgtgcctggccaggcttcatgttttatcagaattgcaacgaatatttgagttacaaaactaggagacataaactaagtcgttatttcaaacattatcctctagaaacatttaaaggcctccaggtaaaatgccattttgtgaattcagaaagttctaggatgaattaatttacgctcgtaatcttatttcatagagctgcatttagagaaaaccagagtctcaaggaaaagaactggctcatggctgtataatctcaacactttgggagcccgaggcaggaagatcgcttgagcccaggagtttgagaccagcctgggcaacatgacgcaaccccatctctaccaaaattaagaaaaaaaaaaatagccaggtatggtggtgtgtgtctgtagtccccgctacttgggaggctgaggtgagtggatcacttgagcctgacaggttgaggctgcagtgaggctacagtgagccatgactgtgccagcacactccagtgagggtgacagagtgagaccttatcaaaaaaaaaaaagaaaagaaatttcttccttaaggaaatactgcttattttttttgccttcaagtcctacggatgtgttaaggcattatactttatattacctaacagagatctatgctggagacatttacaggttaaagcaaaaattcctaattcctttgtagctacaacatcctatgcagttttagggaggcagttttaagttgaaaattatgaagaactcccaaaaatcagttgccccgtgatgccttaagccagatgtgcctatcgttggaaactttcaaacgtacatcagataaaatattctctcatattaagtggaaaactggaaaagaaaatcccttaggtactttccagtactaaatgttctattaagttattgaattttgagatagaatcaaagtaaaattaaacagcttgccttgccagggccaggaataccactaaatgctaaagcataaaacaggacccagcaattcattttcttgctgctaatctactgatattactcctaataaacttaaaaactaatcaagctcctatcaacctactattccaaatcttggcatgtgtgtaaaatatatacacaactaagaacagatttgaaaaatgcttataaaaaaagaagataggctgggcacggtggctcacaactgtaatcctagcactttgggaggccaaggctggcggatcacttgaggtcaggagttcaagaccagcctgaccaacacggtgaagccctgtctactaaaaatacaaaaattagccgagcatggtggtgtgcgcctataatcccagctaatcaggaggctgaggcaggagaatcacttgaacccaggagaaggaggttgcagtgagctgagatcacgtcactgtactccagcctaggcgacagagcaagactccgtctaaaaaaaaaaaaaaaaaaaaaaaaaagataattttacaggaacttcattaagagtattatactctatttctatcaaaggggataaccaaatattcataaatgaggccttatatttcttgagaaagactccccaaaactgagtctgtttttttaaacttcatgagttcattcggaattttccaactttgctgggcatggtggctcatacttgtaatcccaaaactctgggaggccaaggcaggaggattgcttgagcctaggagttcgaaaccagcctgagcattacactgagacctcatctctacagaaaattaaaaaattagctaggcatggtgacatgtgcctgcgatcccagctactcaggaggctgaagtgggaggatcgcttgactccaggaggtcaaggttgtagtgagccatgtttgcaccactgcactccagccgggatgacagagagagaccctgtctcaaaataaagaaaataatttatacaattttattctatctgaaataaccactccataaatagtactgccatgcaatttccagtcctgatgtcatggaatggtaaacattattgtggttccttatataaaacagcatgagtatggcatgctaaaaggatggaatgagtctaagtctcaacatcatcgaaaggcaagaccaactggggccaccaacctttaggcagggcactgaatagcccttgctgaagccacttttcacttgcctccttaaacatcctaagactagacagcccaatggtaacttgaaaaagtaacaaattagtaagagaactgcatcattagagaacacttaaatgagattggccagctaaactcataagaattaatgccatatcaatcagatttatacagtgtaagtgcaacatccttatgacactatttgtcatagtttcttacctgtttaatatcaccttcaaatagtccattagattcaagcgaatacagtactcattacagttttttaaaattaaagaaacaggctgagtgcaatggctcacacctataatcccaacactttgggaggctgaagtcggaggatcacttgaagccaggggttcgagaccagtctaggcagtaaagcgagacccccactccaccccacaaaaaaaatttaaaattagctgggcgcagtggtgtacacctgcagtcccagctactccagaaggtaaggtggaggactgcttgagcccaggttgaggctgcaatgagcaatgatcacgtcactgcactccatccggcctgggtgacacagcgagagaatctctaaaaaaataataaatcaaaaacacttaaaaataaaggccaggcacagtggctcatgcctgtaatcccagcactttgggaggccaaggcaggcagattacctgacgtcagttagagaacaacctggccaatatggtgaaaccccatctctattaatatacaaaaattagccaggcatggtggcatgcgcctgtaatcccacctacttgggaggctgaggcaggagaattgcttgaacccgggtggcggtggttgcagtgagccgagatcacaccactgcactccagcctgggtgacaaagtgagactccatctccaaaaaaataaataaatacataaaaaataaagtggccaggcgcagtggctcacacctgtaatcccagcactttgggaggccgaagtgggtggatcacaaggtcaggagttcaagaccaggctggccaacacagtgaatccccgtctctactaaaaatacaaaaatcagccaggtgtggtggcaggcgcctgtaatccgagctacacgggaggctgaggcaggagaatcgcttgcacatgggaggtggaggtcacagggagccaagatcacaccattgcactccagcctgggtgacagagtgagactctgtctcaaaaaaataaaataaaatagccaagcacggtggctcacgcccataatcccagcaatttgggaggctgaggtgggcagattatccgaggtcgggagttcgagaccagcctgaccaacatggagaaaccccatctctactaaaaatacaaaaaaattagccaggcgtggtggcacatgcctgtaatcccagctactcgaggggctgaggcaggagaatcgcttgaacccgggaggcggaggttgcggtgaaccgagattgtatcattgcactccagcctgggcaacaagagtgaaactctgtctcaaataaataaataaataaataaaatggaggccagatgcggtggctcacgcctgtaatcccaacactttgggaagatgaggagggcggaccacctgaggtcaggagtttatgaccagcctggccgacatgacgaaaccccatctctactaaaaatacaaaaaattagccgggcatggtggtgcacaccttgtagtctcagctactcaggggggtgaggcaggattgctagaacctgagaggtggaggttgcagtgagccgagatcgtgccactgcactccagcctgggcaaaagagcgagactccgactccaaaaaataataaaataaaattaaattgaaacaagcaaaaaaccagttaataatctgttaataatctgttaaagtagaagattaatggtaattatctcaatagttaataggaattttttagccaatgagtctctactgtttattcgcttttttgtaatcttactgttttacgggtttggaaagatacttgacacatagctcctataattattattattattatttttttgagacggagtctcactctgtcacccaggctggagtacagtggcgcaatctcagctcactgcaagctctgcctcccaggttcatgccattctcctgcctcagccttccgagtagctgggactgcaggtgcctaccaccacacccagctaattttttgtatttttagtagagacggggtttcactgtgttagccaggatggtgtcgatctccagaccttgtgattcgccagcctcgacctctcaaagtgctaggattacaggagtgagccaccgcgcccggcagcttctataattgttaatctttaggaacatgttagataatgagataacttttttttctgaattacaaaaggattctcttctcctcccacaattgaaaatactaatttctaatgcattattccacagtttgtattttaatttacttctttcctcaactaagactattaggatattagccatccaattaaaggaaaaaaagattttaaagaaagaaaaacactagccctaaacctgttaaaccagtccacgtgacaggtataaaaattttcctagtcattgactgcaaaggaaataatgttacatagtgatctacacctgaacctgttcacagcactttagagaggtcaacatcagatgagagagcgttctctgaggctggctttcacaataccaggtcttcagcattacctagtttttgaactataaattcactaagataaatgccaccatttcccaagacttcctttttaaaaagcaatttaatcttatgcttgatgtatttctattatgcactggtaaatcaaaacaaaacaagcctggcgtggtggctcatgcctataatcccagcactttgggaggccgaggagggtggatcacctgaggtcaggagttggagaccagcctggccaacatggtgaaaccctgtctctaccgaaaatacaaaaattagccaggcgtagtggcgcacgcgtgtaatcccagctactcgggaggctgaggcatgagaatctcttgaaaccaggagacgaaggttgcagtgagccaagatcgcaccattgcactccagtctgggtgacagagcaagactccatctcaaacaaacaaacaaaacaacaacaacaaaattctacaacactagtaaacacagatggcttcataaattaatactttacctttggcatctttcatatgcccactttaaaatgtttaatattcttgggttcacatcagtcctcctgttatgcattcagttttactgagaaatgaagaaactgaggcaagagaagtgggaaaaaacttgctatttgtagcaagcaggcatctatctggacaggtaaactgtggtcctgctctattaggccacaatgcttttctgaaaagtgcctgtcaaataagcaccacagaaatccttctcatcacagacatccagggcatccccctcaagaagggacaaatatgagtattcttccctgctgagtgagaaaagaccatgtaaccaaagaaagcatgcttctcaatctatactaccgaattgggagggaaaaaatgaatggaaagagagagaaaatccaaggaaataaacttctgagactgaagatgtggttattaggtttatccacacattaggaaattactgaaacatcgcttaagtagaaacagaatcaggaaggcctagggtctttttttttattccagtcttaaacctccaaacaaaaatatctgaaattaaactatttctcctgagcagttatattcttaaatgtctctatagaacccacaaggcctacacgaagtccctgatttttagaggtgatttcaagtgtccattagtgtccactctcccactctcaaatccaaaataatgttggccccgatccgggcaggaccttcacgcacattttcctgtgaaatcattagcttcacatcagcttcctacgtcctatttccagtaacttcccttgatcagcatggcaaacgaggagagtaacaaaaggcatgtacatttactatgtccctcgcagagaacataataaaatcctgggaacaggaactggcagatacaacctgcctggccctggctctcgccacgatacaaaggcacggagagagcaagtgaggtctgcaccccacacctcactctgcaagagagaaaggactttcaatgcaatcagacccaacccgcaacgcccccttcccacgtggtcttctccctctcccgagcccagaatcggattggagaggggtctggaaggaatcagaccacgctggagctgggcaagaggggtggcgggcgagctccaggcagaaactccagccccccttcctagaggagccctgaactgtacgcctcccagttccgggatctgaatccccacctcccgagaccccagacctctccatgtctctagggaggggacctcaaggcctcagagctgcgggaagggctgggctgccccgcacccgatctggatagtgtggagcccaggccgcgtgcgggtgagcggaggctgggaggcggccccctgcctgccgccgcccctcccttggccccagtttctccaggtccccggtcacaggttctgggccggccctcacctcacctcagggtggcaacgtgtgcggtcgggcgattccggagcccctgcgtggaggaactgctgggcgggaggagacgccggcggctcgggcgatggctgacaggcgtgcagcaccaggccggcccggcacacggagaaggggcggggcttcaggggcctgacccgcccccgccccgcccctgtctcccacctcagccggcgagctccatgaggtgactacgtccggggttactccaggccgttcacctccgaccccgctccgggctgcggcgctgccagggccgccggggggcgaggcgcgggcccgagggctcagcggcagccaatgggagggcggcgcggggcggagcgatgtgaggcgatgccgatggtccgagcgcggatctgccattcggggcccagcggctagagggcgggcgggccgcgggcgggccgcgggcgggccctgggcagtcgtggcgcccctggcccggccttcgcggccccttctgccacagccgggtacggggccaacccctcggctcctcctcctggcggagaggggagtgggggaagcggtcccgcatgcgcctcgcatcagggacagaggcgtcccaagtgaggggccaggactagccggcctgtagaggcggggaaagggaacccagaattaaggcgggctagaatggggcaggcggtgtgcgggcccgtttgtctgtttaatcctaacacattaacaaggggtgggcaatcgcgtccactacctgtcctcatcacgctggctggtttccaagtctgggcgagctaagtaaccccatgctggaactccataaccagccccccgtttcgctcctcagccccgagacagcccactccaaaggtgttatacatgctggatcctggcgtgttgaggagaagcctcagtaaacgaagctcagtaagaaggggaatgtaccaaagaaccaccgtcttctgcctgccctgagcaaaatagttgccacagcgttccagacttttcggattggagaatgcttcccgtcctccactgtgggcacgccgagcctttgagaggaagccagtcggtgtctctagttttgccagttacttcatagcaagactttcatggtagctgtgtgttgaaaattaataataactggaaggggtcccaacacaatacaaacattgcgtagggaagaaacttggagaaaattgcacttgagaagaacagggtgaactcagcccttccaaggaggaatttaatgaagcatgcagcgcaccttcttaatgcttacaaacttgtgaggaaggccaggagaggtgcagaggatgacagtttggtaggaagaagttccacgccagagagtaaaaagtgaataggatagaaatacatgcccaggtaagaagttcttggcggaagctgaggcagaaagagggaaagattggtcaacaaggaacaatatttatctaggagccctcataatcccactaagtggggcttccctaagaatttatcaacccatttttaaaataatagggtcaagcacagtggcacgtacctggactgtagtcccacctactcagaaggctgaggtgggtggatggcttgaggcgaggagttcaagtctatatgtagtgtactgtgcctgcgcctgtgaatagccactgcaccccagcactggcaacgtaaaaagaccccatctctaaataaataagttaattaaataacagggattggaagcagagaacttaggaaagatgtggactttacagaacagggattcatatttcacaataattatatcactaatatatcaatcagttggacaaatgtagtgggaggaaaaagataattgggcaagacttcctggtttagtaagatgtttgatttgactcaccgaaaaaaatggcctgggaagagggaagccttgcctttccataacagcagtctctgaagctgacatgaagggagtgacttcaaaagaactaaaaaccatgcggttgcctcttacttttcttttacctttcctagatcctcttaagtaataggaattctttccccaggattcttttttttttttttttgagatggagtctcgctctgtcgcccaggctggagtgccgtggtgcaatctcagctcactgcaacctccacctcccaggttcaagccattctcctgcctcagcctcccgaatagctgggactccaggcacaaaccaccaagtccagctaatttttgtatttttagtagagacggggtttcaccatgttggccaggatggtctcgatctcttgacctcgtgatccgcccaccttagcctcccaaagtgctggccgcaaatgtgagccaccacgccaagtctccccaggattcttaatggtgttgctgtttaccagctttacaagctctgcaaaaccagggatttaccctcaaaaactgtccttatgtgaaatttcagccagcccctgcatgtcctgcttttgacttcactgattattttaaataattgagctttctaaagaactggccaaagaaagtcctaatagaagctacagtgaaaaaaaaagtaattaaggaaggatgagttacgataccaaggtcacttacagaggatctaataatctaattgttatcaccaaatgctaagacagctgggcagagaatgagcaaagagctgtgtctttaagacagtacaactggaatttcagcaacccctgagtgttacggtgtttggtgcatgccacaacctgcccatccctactgtaggttctttagagctgctccatgagttattgctacacaagctattacgtctgtaagaggcggaggaggagaaccaaagggtggagagaacttactatatgagactaacaaatggaagagaaggatgagtggtacatttctagaagctgatactagaggtctgttatgggctgaattgtatcccaaaattcatttgttgaagtcctaacccctaatacctcagaatgtgagtatatttggagacaaagtctttatagaggtaattaaattaaaatgaggtcataagggtgggccctaatccagtatgactgtcgtccttataagacgaggcgacgaggacacagacacacatatgaagacatagggcatgcatggccatgtacaaaccaaggagaaaatatcagaaaaaaactaactgctgacaccttaatcttggacttctagccttcagaactgaggaaatgcatttctgttgtttaagccaccagtttgtggtactttgctataacagccctagaaaacgaatacaaaatcccaaatatatgacttccagggttttcaaggtgatgtaaaggtattagggactcatcctgagcatcccagctaccttccaaccttaaagttgctttcttatcttcctgtgggtaaagtcagaaaagtatgagaggtccctgtcttcaaggtgattatagtctatttaagaagacaaaactagcacattaaaacagagtgtctgtgtcacactctttagatgatagccatatgaatttgtaatagccatagatgagaaaagataaattctcaaaaattgataaacccagatatatataaacattatatgcgccactgtccagacagcttcatttggcatttttcggtcaaatatttagattagggcatcgtttctcaaagcatgtcccactgaccacctgatgaaacaaacactagggtgcgccaggcgcggtggctcacgcctgtaatcccagcactttgggaggccgaggcgaggcgggtggatcacgaggtcaggatatcgagaccatcctggctaatgtggtgaaaccccgtctctactaaaaacgcaaaaaattagccagatgtggtggcgggcgcctgtagtccccgctactccggaggctgaggcaggaaaatggcgcgaacccgggaggcggagcttgcagtaagctgagatcgcgccactgcactccagcctggcgacagagcgagactccgtctcaaaaaaaaaaaaaaaaaaaaaaccaccagggtgcttgttaaaaatgcagattcccagcccttttttttttttttaatcacaactactcactgcagcctcaactcctgggctcaagcgatcctgccacctcagcctctcaagtagctgggactacagggacatgccaccacacctggttgactttttcttttctctttctctttttcttttttttttttttttttttttgagacggtctcgctctgtcacccaggctggagtgcagtggcacgatctcggctcactgcaacctccacctcccgggttcaagcgattcttctgcctcagcctctcaagtagctgggattactggcgcgtgccaccatgcccagctaatttttgtatttttaggagagacgcggcttcaccatgttggtcaggctggtcttaaactcctgaccttgtgatccacccgccttggcctcccaaagtgctgggattacaggcgtgagccactggacctggccgactttttctttttttaaagcatccctaataattaatcaccctaaagtttgagaacagtcgtttaagatttatcattattgttcccctctttgtgtgccagagtctctgttgaacaacaaggccttcaatacctgtcactcttaggacaagaaagtctctcaagtcaggtttgagttgaatcaagggaggaaacaaagtgccttaatagaaaatagaaccatgggctgggtatggtggctcacgcctgtaatcccagcactttgggaacacaaggcgggtggatcacccgaggtcaggagttctagaccagcctggccaacatagtgaaaccctgtctctaataaaaatacaaaatttgcggcagggcacggtggctcatgcctgtaaacccagcacttcgggaggacgaggcgggtggatcacctgagatcaggagttcaagactagcctggccaatatggtgaaaccctgtctgtactaaaaatacaaaaaattagctgggcatggtggcaggcgcctgtaatcccagctactcaggaggtgaggcaggagaattgtttgaacccaggaggcagaggttgcagtgagccgagatcgtgccactgcactctagcctgggtgacagagtgagactctgtcaaaaaaataaaaataaaaaataaaaaaattgctgggtatggtggcacgtgcctgtagtctcagctacttgggagactgaggcagcagaatcacttgaacccaggagacagaggttgcagtgagccgagattgcaccactgtactccagcctgagcaacaaagcaagactccatctcaaaaaaaagaaaagagtccagccatggtggctcatgcctgtaatcccaaaactttgggaggccaagacgggcggatcacctgaggtcaggagttcgagaccaggctggccaacgtggcaaaatcccatgtctagtaaaagtacaaaaatcagcctggcatggtggcgggcacctaaaatcccagctacttacgaggctgaggcaggagaatcgcttgaacccgagaggcagaggttgtagtgagccaacaggccactgcactccagcctgggagacagagagagactccgtctcaaaaaaaaaaaaaaaagaaaaagaaaagaaaatagaaccatgaagagccccctgtcctggggctgtctgaccatgaatccaaattcgtagataacaaggtcagtgatcaatttttaggacagagaatagaggaattattgggatattatttcctgctgaccaccaatagtcatactttaatctggcttctggcacttgccatgcttattcttatccttatacctttgtttatggtggcagacttgtccaacttttctcctatttttctgaatctttctagtccttggaagtcccattttctccaagatttctcttacttctccagctttcactgatctctctctcctttgaattcttgtagcaatatggtcataccacacagttcagaattttttttttgagacagagtctcgctctgtctcccaggctgtagttcagtagcgtgctgtcagatcactgcaacctccgcctcccgggttcaagtgattctcctgcctcagcctcccgagtagctggaatcacatgcccagccaatttttgtatttccggcagagacagagtctcactatattggccaggctggtctcaaacacctgacctcaaatgatcctcccacctctgcctcccaaaatgctgggattacaggtgtgagccaccatgcctggcccacagttcagaatttaattaggatatatttttttgtctgcatactggttttagctctccagttaaatcctgaaggcagagaccatctcttatagtttgctacccccttttatagctcttcaagtaggactaggtatttctattagtaagcgcttcattgactgaaataaagattagctctgtacctgagaggccactctgctcctgatgcctgcttatccgtcttcacgttgtctctgagaggcaaagcctccagtgggatatatagctgctttacagatggacagaattcatcaagaaagtcagtgccttgcccacaactgtggctccagttgtgatataaaagaaaaataagacacaaagtccttatctgaatactatgtctctttgctcttgttaatcactccagtttatccagaattaagagcctgaaggaacttcataccataaggtcagaaaatctcctcaggaaggccacttcataagtctggtcctaatgatgaaaggtagaattgcacaatgaaggacagcatgagtagtagagactccccacgatgttttcacatggacacagggttttcacatggcatttctgctctcactccttccttatccaatggcaaacacttccagtctctatacttcagccagttaccaaatcttaacttcttcctccatgacacctccaatatatatgtttttaagatccctttctaagtcctacacacctcacaactaaaatacctggagaaattttaaagggctctttaaaaacaggaaaatggacaagatgacttgtttggattttgcccagtcgtaggattctgacattttatgttgatcagctttatagcctagccatccctgacttcactttcctctaaagccatgacggtgctcctggtaagttgatttcctgccccatccctaccttctctttagacttccctagtgtctccatcattcctatatcaggttcaggtttttcctgctacatatttaggcctctacctgtcttctaccttcactctctattgttgttattatatatgaaacacaatacataataaaatataacattaataattttgtagagcctttatcgtcaagaaaaattgagccatcattcaatttctttttatccttttaataccttgtcttaaaattttcctgtatgtgatatcttagagcagaagatttcacaatgtcatgtcttttttttttttttttgagacggagtctcactctgtcacccaggctggagtgcagtggcacgatatcagctcactgcaacctctgcctcccgggttcaagcaattctcctgcctcagcctcccaagtagctgggattacaggcacctgccaccacgcctggctaatttttgtatatttagtagagacagggtttcaccattttggccaggctgatctggaattcctaaccttgtgatcccacccgccttagcctcccaaagtgctgggattacacacgtgagccactgcacctggccacaatgtcacgtctttttaaaaaaaaaatctcacctctgggccaggtgtggtggctcatgcctgtaatcccagcactttgggaggccaaggcaatagggttacctgaggtcaggagtttgtgaccagcatgaccaacatagagaaaccctgtctctactaaaagtacaaaaattacctgggtgttgtggcaggcacctataatcccagctactcaggaggctgaggcaggagaatccgttgaatccgggaggcggaggttgcagtgagccaagatcatgccattgcactccagcctgagtgacagagcaagactgcgtctcagaaaaaaatatatatatatatatcatctcacctctggttaactcctagacctgcaggtagaaagttattttccaacacaagtcttgtttatcagtggacctattgtgctgatgtgcccaattttcttattggaaaaagaaaaaaaaaaaaagaagaaagaataaagacaacaaaaaatccatgaaaaggaaatgtagcttcaatcaatgaacaagatggtcataatcagttgaataacatagttttgcgggtgaatacaggcaagcaaaactgagaagaaccgattcttggtattggcagtgtcagtctcaagagcggcagcaactctaccttctctgtgctctgtattataaacagcttgagctctttaatcaggctatgctttaaatcctgactctgtcgctaattagctctgtggccttgaggaactgacacctttctgagcctcagtttccttatctatattatatatatctatcttatattcaggatataaagcctaccttctaaggtggtgttttggattaaatgatgtaaccaacatgttaagcttctggcacagagcttgttagatagtaggcacacagaaaatattactttcccctttctctccatgttcctttcctttcatttcctattagtaatcgatacagaacagaatgctttatggatcctcaattaattcagaaattgtgattgctgggcacagtggtttatgcttgcaatcccaacactgtgagaggccaaggtgggtggatcacctgaggtcaggagttcaagatgaacctggccaacatgatgaaaccccgtctctaccaaaaatacaaaattagccgggtgtggtggcacacacctatagtcctagctacttgggaggctgagaaaggagaattgcttgaacccgggaggcggaggttgcagtgagccgagatcacaccactgcactccagcctgggcaagacagagtgagactccgtctcaaacaaacaaacaaacaaaaaattgtgtcattactaaattcactgcctcctgcacccaccatgagcaacagagtggaggccctgtcttagctatgagggaggctgaggaaggagaatcacttgaacccgaggggcggaggttgcagtgagccgtgtttgcaccactgcactccagcctgggtgacagagcgagactccgtctcaaaaaataaataaataaaaaattcagtggctgggcactgtggttcacacctataatcccagaactttgggaggccaaggtgggtgaatcacctgaggtcaggagttcaagaccagcctggccaacatggtgaaaccctgtctctactaaaaatacaaaaattagctgggcgtggtggcgggaacctgtaatcccagctactcgggaagctgaaggaggagaatcacttgatcccaggtggtggtggttgcagtgagccaaaattgcgccattgcactccagcctgggtgacaagagcaagactccatctaaaaaaataataataataaaatgaaaattcagttcaccaacccatccgccccaatatttccaggttaatggagcatgtgatcagggaccttgggatattatgaatcctttacccttacttggaaggagcaaatgactgtggcctgagcttctgagtaccaaccaaagggctggcacgtgtgagtatgcctggccccactcaggcttattattgcatcacacaggaaagattctttggcccctttggcaagcatgtgtaatagtaggaacctgcatatattacaagtaggagtgtaatgaggacaatcccttagaaaacagtttggcattaattggtaaagttgtacataccctacataccctataaccagcgtctacttctggatttataccctggagaaactttcaaaactgccccagaaacattgctcattatggctacaaactggaaacaacacaaatgtctctcaacagcagaatgaatatataaattgtgatacattcatacaatgaaatattataaagcaatgagaatgaacagatgattgctacatgaagaaatacggatggattttaccaacataatgttgagcaaaaaatgtatgtttcctgctacaaaaacaggcaaaacaggccaggtaccagtggctcatgcctataattctagcactttgagaggctaaagcaggaggatcacttgaggccaggagttcgcgaccagcctgggcagcatagggagaccctatctcacaaaaattataaacaatttagctgggcaagtgatacacgcctgtagtcccagctacttgggtggctgaggtgggaggattgcttgagcccaggagttggaggcttcagtgagtcttgatcacacaattccactccaggctgggtgacatagcaagaccctgtcaaaataaaacaacaacaaaaaaatgggcaaaacaagccaggtgcatgcccctgtagtctcagctagtcaggaagctgagatggtaggatcacttgagcctaggagttcaaatctggcctgggcaacacacagagagagagagaccccatttctagaaaaaaaaaaataggcaaaactcatttgtgatggcaagaatctggataatacattcttttttttgttttgtttttgagatggagtcttgctctgtaactgcaggctggagggcagtggtgcaatcttggctcactgcaacctccacctcccaggttcaagcaattctcctgcctcagcttcccgagtagctgagattacaggtgcgtaccaccacacccatctaatttttgtatttttagtagagacgaggtttcaccacgttggccaggctggtctccaactcctgacctcaggtgatctgccctccttggcctcccaaagtgctgggattacaggcgtgagccactgcgcctggcccctcctttttttttttttttgagacagagtctcactctgtcaccaaggctggagtgcagtggcccaatctcggctctgcaacctctgcctcctgggttcaagcgattctcctgcctcagactcctgagtagctgcactacaggcatgagccaccatgcccatctaatttttgtatatttagtagagacggtgtttcaccatgttggccaggctgatcttgaactcctgagctcaggtgatccacctgcctcagcttcccaaagtactgggaatacaggtgtgagccacagtgtccagctgataatatttacttttgatggtgaggagtgactgggagaacacataaaagaaatttccagcccagacgcggtggctcacgcctgtaatcctagcactttgggaggccaaggcaggcggattgcctgagctcagtagttcaagaccagcctgggcaacacggtgaaaactagtctttactaaaaaaaaaaaaaaaaaaaaaaattagccgggcatggtggtgtgtgcctgtagtctcaactacttgggaggctgaggcagaagaattgcttgaacccgggaggtggacgttgcagtgagccgagattgtgccactgcactccagcctgggtgacagagctagactctgtctccaaaaataatgtaaataaataaataaataaataaataaaaattaggccaggtacggtgactcatccctgtaatccctgcactttgggaggctgaggtgggcggatcaccctgaggtcaggagttcgagaccaggccggccaacatggcgaaaccccgtctctactaaaaatacaaaaattagccggacttggtggcacatgcctgtaatcccagctgcttggaaggctgaggcaggagaatcgcctgaacctgggaggcagaggttgtagtgaactgagattatgccactgcactccagcttgggcaacagagcaagactccatctcaaaaaaaaaaaaaatacatagagtttgattccatttatataacattcaaaagtaaacaaaatatttttagtgatacatatatagagagttcaatttttttgtttgtttgtttttgagatggaatttcactcttgttgcccaggctggagtgcaatgtcacgatctcggctcactgcaacctccacctcccgcgttcaagtgattctcctgcctcagccccccgagtagctgggattacaggcatctgccaccatgcctggctaattttgtatttttagtagagacagggtttctccatgttggtcaggcgtgtcttgaactcctgacctcaggtgatccacctaactcagcctcccaaagtgctgggatacacgcatgagccacgacgcccggctgatagttcaatgattttacaaaacatggaaaaataaagattgggaggaggaaagagaccggaggaccagaggcacagacatgtaaagagcatccatgatgctggcaatgttcaatttcttaatttgggtgatggtaacatatgttcaccttttcagtattattattattattgaaaatatacttatgttctatatactctcctgtatatatggtatattccacaattaaaaaacggccgcggccaggccgagtagctcacgcctgtaatcccagcactttgggaggctgaggcgggtggaccacttgaggtcaggagtttgagaccagcctgaccaacatggtgaaaccccgtctctactaaaaatacaaaaattagccaggcgtggtgatgggcgcttgtaatcccacctattcgggaggctgaggcaggagaatggcttgaacctgggaggcggaggttgcagtgagctgagatcacgccaccgtactccagcctgggggacacagcgagactacgtctcaaaaaaaaataaaggaaaagaaataaagaaataaaatggccatgctggtggctgatccctatgatcccagcactttgagaggctggggtgggagggctgcttgagccaggagttcaagaccagcttcggcaacatactgagaccctgcctccattattaaattttttaaatttaaaaacaaaccaaaacaaatgaacaaaatggcatgcagcctttaaaaagcagtagcataagccagacgcagtagttcacgcctgtaatcccagcactttgggaggccaaggcaggtggatcacgaggtcaggagatcaagaccatcctggctaacacggtgaaaccccatctctactaaaaatacaaaaaattagccaagcgtggtggcgggcacctgtagtcccagctacttgggaggctgaggcaggagaatggtgtgaacccaggaggcggagcttgcagtgagccgagatcgcgccactgcactccagcctgggcgacagagcgagactctgtctcgaaaaaaaaaaaaaaaaagagtagcatagtgtgcaggtacaataattttaaagctagaagaggccttgtaagccattttgtctaaccacctcattacagaaaccgaaatagaggccaagagaagacaagtgacctgttcaaattgatttagtcaattaaagagcctagggtaggcctcctggcttcctgtcaagtgctccttctgcagacccatcctgattcatccatttggtcctagttcctactctcttccaacgccatatctctgaactgcatatgtcataaaactcataacttttttcctgctaaatttgatgtttttgttgtgggaaaaggagatcagaagagatatactctgctccactgatattccaaatgcttagaaagtcagtcaaaatatctaggagtagagaaatagtctattagaaataatagaaacatggatctatttgtctacacttggattttttttttttttggtgggggaggatggagtctcgcactgtcacccaggctggagtgcagtggtgcaatctcggctcactgcaacctccgcctcccgggttcaagtgattctcttgcctcagcctcccaagtagctgggactataggcatgtgccacgacgcccagataatttttgtatttttggtggagatggggtttcaccatgttggccaggctggtcttgaactcctgacctcgtgatccacctgactcagcctcccaaagtgctgggattatgggcgtgagccacggtgcccggcctactcctggatattttgactgcagctcttccaccgctctgcccccgacagtatggcctactccaatatgcaggctgactttttttttaaatggagtcttgctctgtcgcttaggatggagagcagtggtgtgctgttggctcaccacaacctctgcttcctgagttcaaatgattctcctgtctcagcctcccaagtagctgggattagagacatgcgctaccactcctggctaattttgtatttttagtagagacagggtttaaccttgttagtcaagctggtcttgaactcctgacctcaagtgtccacccgccttggcctcccaacgtgctgggattacaggtgtgaactaccgtgcctggcccaggctgactttagagtctttaagttacaaaagaaaagggtagggtctgcgaggtgatcaaagaaaactcttagacttcatctttcgccaagcacaaggtctcttttgggaaaagtgagctcttttgccaccttgtgacactggatgagaacagcaagccctcagatcaattcctactcctgctccaaggtggcagcattgtaccgtggcatctaggaactaatgtacagagagtttcaaatagagcaacaggagggaaggtgataatacctcaggggagcagagaatcatgtcatcatgttaaggaaatagtaagcaaaaatcacaaaacccaaggaaggcaatggagcccctctgccctaaccacctcctctgctaagagaagcaggcagccagaggcaagagggtggggaggatgaataaagatttccttggaccaataaagatgtgaggcatttatgttccctctagtcagtggcctcatttctctgctttctttctcatagcaaaacttttttaaaaagttttctagtctgggtgcagtggctcacacctgtaaccccagcaatttgggaggccaaggtgggcagattactggagctcaggagtttgagaccaacctgggcaacacagtgagactgtgtctctacaaaacatagcccatctccaaaataaaacaagaccaaagaagctgtagagtttgataaagatggggtagatctttattctcttttttttcttttcttttttttttttttgagacggagtttcgctcttgttgcccaggctggagtgcaatggtgcaatctcggctcactgcaacctccacctcccaggttcaagcgattctcctacctcagcctcccaagtagctgggattacaaacatgcgccaccatgcccagctaatttttgtactttcagtagagatggagtttctccatgttggtcaggctggtctcgaactcccgacctcaggtcatccacccgcctcagccacccaaagtgctgggattacaggcgtgagccaccgcgcccggcccttcattctcttttatgctccatctatctatgccatgacaaagtctacagattattacactagacactaaaaaaatacaaatttggaaaaatcttcaacaacagttatctgtctaggaaaaccttcccaagccacagacagtaccactcacctgccgtatttagctcttcctcacaacctctcagcccaatggtcatcagaatgttgtccaccaatactcacttcactattcaggagtgtgaagatgtgcaaaactcaataggtatgtctgtgctaatgtgagtttatatatataactggattaattctagagatcatatggttcagggccggctggggtggctcacggctgtaatcccagcactttgggaggccgatgggggcagatcacttgaggtcaggagttcgagaccagcctggccaacatggtgaaacctgtctctactaaaaatataaaaattagccggcagggtggcacacacatttaatcccagctattcaggagactgaggcaggagaatcacttgaacccaggagatgaaggttgcagtgagccaagattatgccactgcactccagcctgggcaacagaacgagactccatttcacaaaaaaaaaggccaggcacggtggctcatgcctgtaatcccagcacttcgggaggccgaggcaggtggatcacgagatcaggagattaagaccatcctgtctaacacggtgaaacgctgtctctactaaaaatacaaaaacattagccaggcatggtagtgggcgcctgtagtcccacctactcaggaggctgaggcaggagaatggcgtgaacctgggagacagagcttgcagtgagccgagatcgtgtcactacactccagcctgggcgaccgagcgagactctgcctcaaaaaaaaaagagatcatatggttcaggactctcaatttatagaagagaacatttagatcccaagaagtcaagtaattttctcaaggtgatagctcataaaagggcctgtactagaactcaattgtactgactcctagtcctagtttcctgctctatttctataattcctgctctagaaattatattccttactagaaatctccacatcttttcatgaaagtatataaatctctgtgcctgtgtcagtgagcatgcatgtaaatgtctacgtgtctatctgcaagtatttgtaaagcatatcaatgggcgtttatggccttcctgctcgagaaacctctaggtaatctagttctctatgtcggcaccggcagcgaagtcagaagaagtctgagtgaattattaataagcagaattagccctttctccaattagatctattcctgggtcttcaggaaatggggcaaaataatcagggtggaatcagagtctctcagggtcaaacttggttccagctgcgtgtggtgaaagcaactagaggcagagctatcaagggctgtgacagatgagcagtggtctgtctgcaatgagcatgtgctcaagctaacatggataccatcttggtcttcagcctaatcattgcatcctatgatgccaacaagaaaggtatgtaattctctagcctaatctcctggaaaatacagagagaggcctagaaagagtttcggggtctcttccaccagatagagatgtagctgatatccagcaagcaatactttccagagttaatcccatgtatccactcgcctctaagaaggactgcaacttattcattccagagagatagctgtctgtttcatgatgagaggtcttcagagaatgtgatgcattcttatgtcttgttcatgtaattaacattaaaagtcctttcactgttggatggctttctttagagtttcagtattgtcatcacctaaggttcccaaattcatactgttcataagatgttgccttttttaagttggtacatgtaaatagctagacggtgatattcttgggtggggagagctgagggaaagggtgatattgggtggaatggcatcatttgctgctctttggtaactgcttatttaaaatatgagttttcaaagtttcataaacatttcatctctaaaattagctaatcaaggctgggcatggtggctcatgactgtaatcccagcactttgggaggccaagattggtggatcacctgaggtcaggagttcgagaccagcctggccaacatggcgaaaccccatctctactaaaagtgcaaaaattagccaggcatggtggcatgcacctgtaatctcagctactcgggtggctgaggcataagaatcacttaaacctgggaggtgaggttgcaatgagctgagatcgtaccactgaaatccagcctaggtaacagaatgagactctgtctcaaaaaataaaaaattaaaataaaaaaataaaattagctaatcagaattaagaccaaatggcacaaagtgcagcagtaacgaatttgacaaattataaaaatgtcacaaccctttgaattatgtgccaaaaagcataaataactaagacctatggttctgtggaaacctatagagataccaaggtcagacaatataaatctccaaaagctttatttaatacaagaaagaagacagaataggagggagaagagaaaataagcagtatttaaggaaatgggttggttagactttcattaacttagtaaattttcttaactctatttgacctttctttgtcctaagggtaatagattggtacacagtattctttatactaggtcaactactactttgtatgtatttggctgggtgttcttttttgagggccgggcgtggtggctcacacctgtcatcctagcacttttgggaggccaaggcaggtggatcacctgaagtaaggagtttgagaccagcatagccaaaatggcgaaaccccatctctactaaaaatacaaaaattagctgggcatggtggtgcatgcccgtaatcccagctactcgggaggctgaggcagaagaatcccttgaacccaggaggtgaatgttgcaatgagcggagatcacgtcactgcactccatcctgggcgacagagtgagactccgtctcaataaataaataaataaataaataaataaataaataaataaaagtaaagtctttttagagagtgtttgatctcccaagttgcaagttttatgagcaggaactgcaatctttcatatcttctccattgcccagaattctaaaaagtaagtaccagtaaattctgattttccccaaaccttccccggttcccctcctccccctctgctcacccccagacctcagagatagcagttgccgactggaacagctgcctgggatcttcccaaaagacgtgagaagcatcagagaattgcaaatgcaaggtagggaatgggtcctttctggaaaatgatattgccattccaaaaaatttttacctttaaaagatatctcatcttcccacttcctagcccatatctcaaatatcctattttaaggatatgtatcctcccagggggctttctggaaaccaatctttaaattaactgtcattacctaaggcatgcttatattactcaaatggatggagatgaaaaaagagaaggaggcagaacctacccctctctgcattaaagaaaaatctatgagcatttctctgtgctaaatttactgctgtcaccaaccttcatgggaaccatggcagaagaaaggcaggacttgtctattagtactatgaacacaaactgaagaagttaactaaaaggagagaaagtacagcagtggagtttagcaggggtcatgaatggaaatgggttagcttggcactgttcagattaaaaaccagctttggccaggcatggtggctcacacctgtaatcccagcactttgggaggccaaggcaggtggatcacttgagcttacgagtttgagactagcctgaccaacatagtgaaaccccatctctactaaagatacaaaaatcagctggatgtggtggtgcacgcctgtaaccccagctacctgggaggctgaggcaggagaatcacttgaaccagagaggcggaggttgcagtgagctgagattgcgccattgcactccagcctgagcaacaagagcaaaactctgggcaacaagagcaaaactcagagatcgtgccattgcactctagcctggaccacaagagcaaacgcttcaaggtcgggtgcggtggctcatgtctgtaatcccagcactttgggaggccaaggtgggaggattgcttgagcccaggagttcgagaccagcttgggcaacacagcaagaccctgtcttttaaaaaattaaaaaattagccgagcaaagtggcatacacctgtagtcccatagtcacagctactcaggaggctgaggtgggaggattgcttggagatcgagggagtttgaggctggagtgagccatgattgcgacactgcactccagcttgggtgacagagcaaggcaccgtctcaaaaaaaccaaccaaacaaaaaacaaaaccagctccatttttctatctggttcttctccttccagaaactcacacagaaaccaaaaggacaacattcattcaaaaccggactatagctaccctgcagtgccttggctctgacagcaaagtaaaagtcaaccttgtatatttggagagaaggccaaaggtcaagcatattttgaagaacctgagaatcattgctgctccccgcagaaacagctctgcctcctcaagctgtcacctaatccccacatccaagtttcagactggatctcttctaaaaggcaaaggtgagattggaaaagaggaagggggcaggcactaacttttagttgacatccttgaaggcagccagaactccgtagcaggaaaagctacaagaaaatgaattatccactttttgatggggttgtttgttttttttcttgtaaatttgtttgagttcattgtagattctggatattagccctttgtcagatgagtaggttgcgaaaattttctcccatcaaaaagtgggcaaaggacatgaacagacacttctcaaaagaagacatttatgcagccaaaaaacacatgaaaaaatgctcatgatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttactgcggcactattcacaatagcaaagacttggaaccaacccaaatgtccaataatgatagactggattaagaaaatgtggcacatatacaccatggaatactatgcagccataaaaaacaatgagttcatgtcctttgtagggacatggatgaaattggacatcatcattctcagtaaactatcacaagaacaaaaaaccaaacaccgcatattctcactcataggtgggaattgaacaatgagatcacatggacacaggaaggggaacatcagactctggggactgttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataataaaagaaaaaaaaaagaaaatgaattatcctccccttgggcaaatctacgtgctctctgagagtcagttttataatctctaagatcccttctagccctgatactctgtgattttcatgtgatctccatttctgatggatcttctttcaacagttttttaaaatttctttttttttgtttttgtttttgagatggtgtctcgttctgtcacccaggttggagtccagtggtgcgatcttggcccactgcaacctctgcctcccaggttaaagtgattctcctgcctcagcctcccaagtagctaggattacaggtgtctgccaccatggctggctaatttttgtatttttagtagagacaggatttcaccatgttggccaggcaggtcctgatctctgacctcaagtatctgcccgccttggcctcccaaactgctgggattacaggcgtgagccaccgtgcctggccaggtttttttttttttaaatttcattttgcatgcacacagtaaaatattcaaacagtatagatttatagtgaaaagtaagtctctctcctactcctgtctctcaattctccagttctctatccctgatggaaccactattatcaacttattatatttccttccggagatactctaagaatgtatgaatgtgcatattttaaaaacataaatggtaacataccatatacactgttctgccccttgcttttgcttgtttttgttttttgttgttattgttattttgttgttgttgttgttgttttctttggagatggagtctcactctgtcacccaggctggagcgcagtggcgcgatctcgtctcactgcaacctcctcctcccaggttcacgtgattctcctgtctcagctttccaattagctgggattacaggtgcccaccaccacacccagtgaatttctgtatttttagtagagacaaggtttcaccatgttggccaggctagtgttgaactcctgacttcaagtgattcacccacctcagcctcccaaagtgctaggattacaagcgttagccactgcgcctggccaatcccttgcttttccatttaataatatatcttataggtcgttccatttcaatacgtatatatttaccccatacttttttatatttgcctcattctttttaacagttttacattattccatagtatgtctcttccatagtctttttttttttttttttttgagacagagtctcgctccgttgcccaggctggagtgcagtggtgcgatctcagctcactgcaagctccgcctctcgggttcacgccattctcctgcctcagcctcccgagtagctgggactacaggcactcgccaccacacccagttaattttttgtatttttggtagagatggggtttcaccgtgttggccaggatggtcttgatcgcctgaccttgtgatctgcccgccttggcctcccaaagtgctgggattacaggcgtgagccactgcacccggccatgtctcttctatattctactagccccctattgatatatattttggtcgtttccaatcttttgcaaatacaaacaattccgaaaacaatgaccgtatatattcttcttttttctcttttttcttttaataaattcttttcccctctttcactattactcagtatctatatatattcttcttgtatacctgcaatttatcaataagatttatcaatttatcaataagattccaagaagcaggattgttgcatcaaaggctgatagttactgctaaattaccctcactagaggttggttccattgtgcatatccacactgggggagaatgcctattcccccacagctgctggacagtggttcttaacctcagcctgaagtttctctccttctgccctcctttccttttctcaccctttctttttttcatatagtttttttttttctttagtgtagccggttcctctttataaactggcagtcccctagatgctattgctacattactggaaaaataaaataaaacttgacatttttagagaaattggggatccacaagcagaataatggaaaaaactttaaactctagactaaaactgggaaataagtggataggctctcaggatgttacagaaaaactcttaaaaactcaaaagcgtcaggtgcggtggctcacgcctgtaatcccagcactttggaaggccgaggcaggcggatcatgaggtcaagagatcaggaccatcctggccaacatggtaaaacctcgtctctactaaaaatacaaaaattagctgggcatggtggcgtgtgcctgtagtcctagctactcaggaggctgagacagaagaatagcttgaacccaggatgcagaggttgtagggagctgagatcacgccactgcactccagcctggcgacagagcgagactctgtctcaaaaaacaaaacaaaacaaaataaaaaaattagccaggcatggaggcacgcgcttgtagtcccagctactcgggaggctgagacagaagaatgacttgaacccgggaggcggaggttgcagtgagccaagatcacaccactgcattccagtctgggcaatagagcgagactccatctgaaaaaataaacaaactcaaaagactctggcagggttttgaactttgaatattaatgcaaattaattaaatccaattgtttccctcttaacatgtgacaccttgctgtccatggcagctgtgttggggaaaagtggacttaagtcattttggagtttggagcactctgggtggagtgaatatagtgctaggcattgtgagacttggggcaattaaggacattagctcttagaaattgggacaaggaaaactgaggggttaaaggggaggagagatgccaaagatcaacctgacctaattcaaaaatttgcacttggttagcctcccagagaaaaagaaactcttcctctttccttcataacatagtagttggttcccacatctagaatttaagctaatactctgtactatttgagctatgcaaaaagattaaatggatatttgtagattagtttggggacctaatcatcactcatgatacatttttatgaaaccataatgatgaatcccaaaaaacctatttatttatttgagacagagtctcgctttgtcccccaggatggggtacagtggtgcaacctcagctcactgcaacctccgcctcccaggttcaagcaattctcgtgcttcagcctctcgagtagctgggattacagcaccaccatgcccagctaattttttgtatttttagtagagatagggttttgccattttggccaggctggtctcaagctcctgtcctcaagtgagatcacttgagcccaactcagcctcccaaagtgctgcgattataggcgtgagccacctcacttggtccaaaacaaccaatttatgtatgaacttttgaaacataatcccttctacaagtttgaaacttcctattctgaatttaaatctccactcaataccagaagtgataaacctcaaacagggtagaaataaaaattagagccgggcgcggtgtctcatgcctgtaatcccagcactttgggagcccgaggcgggcagaacatgaggtcaggaattcgagaccagcctggccaacatagtgaaaccccgtctctactaaaaatacaaaaattagccgggtgtagtggtgtgcgcctgttgtcccagacagtctgcataggaggatgtcctggaaatggtcagaagacagttcatgaaaatgtcctcaagtaaaatagaaatttggaactgtaagggtgagaatgttctgcaatacaaatgctcatcagaagatgtgggtcaacatggaatgtagaaaaaggtaaatggagactatttgttattatttaagaaatttggaaaaggaaaagacggctgttatcaatatttcaaaatttccttctggtggagacagatgactcattaggtcatctttttccccctctttcaatcataatatcattcagtttgcaaagtgtttacacacatgctttctcatttttatttgtttctgatcttcacaacacccctgtgaaataggtagagcaagtattattttactattaccatcttacagattaaaaaaaaaaacacagataacttgtggtgacttgtccaaagtgagatttgtttatttttatctaatgtgacttataaacatgtaagttatcacttcgaagaactgactagcactatgatgaaaatgttcttgttttttcttttgaacttgttgactttatgtctgtctctgccaatgtctgccaacactgtcttcctgattaaactggaatcggggatcacctcttcccctatgatttcatgtacagtgcctggtactatggccactggcctctgaggtaaagaactatcattttctcatggacttaagacatggaagagtaatttagaaaagtcaagtagaatttatagaccttaatttaataagcaatgatatgagaccactaaaaatagaacagaaaccacactgtctgaattggattaggtcaattctggagacgagtgaggttatttccagactccagctagactctatccatctcccatcacttccactgctggtgtgaatcacatcatctctcatctggacttttgcaatggcctcctaacaggttaccctccttctacccttgcccaccccaacccattccccacacagtagcccagagatcctttgaaagcaaggccaggctgggcacagtggctcatgtctgtaaccccagcactttgggaggccgaggtgggcagatcacttgaggtcaggagtttaagaccagcctggccagcatggtgaaaccccatctctaccaaaaaatataaaaattagccgggtgcgatggcatgcacctgtagtctcagctacttgggaggctgaggcatgagaatcattttaacctgggaggcagaggttgcagtgagctgagatcacaccattgcactccagcctgggtgacagagggggaccctgtcttaaaaaaaaaaaaattgctgaatgaatgaaatcaaggagtacatgaagctgggtggcttttccttcttccagctcctcctgctttccccagtcccctctcagagtagttgatctagattctactagacacacttgcagcagtcattaaggctaactgtgatatttcatgttcttccttggactttggagccatctctttttaaagaaggaaactgtcaacagtttttatggccttcatctttattattattatggcctaaataatgataggcaatgatatcattggcatgactccttcactttgatcctatgttagttaaaagtcccatgggcatttaatccatatctcttattagtgtctctatcctcatttactcttggcattattttgtgctcacaccctaaacctatggacagacaggttaatgggaccacaattggaagtttactatcagctgggcagggtttcatcagataaaaccaaaggcaggataaagttttcccctaaagtttcatcttttctactttgttttatagcttttttaccagggatctcacaatgtaaagtcctgggggcttcatcagagacttttcccaccactgccccttctataactcctgggaataaagaaggagagaaaactacaagtaccggtaatttttctagctttgaaatgacaaagtacagaataagtaggagtaaaatgggaacagaaaagaaacatttttagccccagcgttagtctggatctactgatatttttcttgaggttgagaagttactgaatgtacattgaaaaatcattcaattttttattttaaaaaattagcttctctaggccgggtgctgtggctcatgtctgtaatcctagcactttgggaggccgaggtgggcggatcacctgtggtcaggagttcaagaccagcctgaccaacacggtgaaaacccgcctctactaaaaatacaaaaattagccggacgtggtggcaggtacctgtaaccccagctacttgagaggctgagaaagaagaatcgcttgaacccaagaggtggaggctgcagtgagccgagattgtcccactgcactccagcaggggcgacagagtgagactttgtctcaacaacaacaaaattagcttctctataaaggtcccagaaatgtttgtaatttgacaccatcaatgatcatttatctccacgcaaatgagctcaccctgtcgccagaattagggacagaaaaaactgtatttctgtagtaggtaattctaaccactgtatgtatagatggacaatatttaaacactaagcaattataagagtgatgacaccaaccaagtgcttttctttttctttttttttttttgagacagggtcttgtgttgcccagactggagtgcagtagtgcaaacatggctcactgcagccttgacctctggggctcaagtgatccccccacctcagcctcctgagtagctgggactacaggtgtgtgccaccatgttcagctaatttttaaatttttgtagagacagggtctcaccacattgtccaagctggtctcagactcctgggctcaagcgatcctaccgcctcagcctcccaaactgctgggattacaggcattgcccaccacgcccgtccccaagagcatatatttgttttgatatggagtctcactctgtcacccaggccggagtgcagcgatgtgatctcagctcaccacaacctccccctcctgggttcaagcaattctcctgcctcagcctcctgagtagctgagattacaggcatgcaccaccacgcccggctaatttttgtatttttagcagagacagggtttcactatgtttgccaggctggtctcgaactcctgactttgtgatccgcctgcctcagcctcccaaagtgatgggattacaggtgtgagccactgcgctgggcctccaacagcatactttcatcttcactgtttttttgtttttgttctttaagatggagtgtcactctgtcccccaggctggagtgcagtagcgtagtctcagcttactgcaacctctgcctcccggatccaagaaattctcctgcctcagcctcctgagtagctgggacaacaggcatgcaccaccatgcctggctaatttttgtatttttagtagagacgggtttcaccatgttggccaggctggtctcaaactcctgacctcaagtgatctacccacctcagcctcccaaagtgctgggattacaggcatgagccaccgcacacagccttcttcactgtttttttagcaacagtcctccttaaattggccaggactaaaattctgtaagattccaatttgggttacatcctagtttctaccaggggaaaaatgtgatattagtaataatgagatgcacattagggccaggtgagttggctcacacctgtaatattccagcactttgggaggccaagactgtaggatcacttgaggccaggagttcaagctcagcgggaaatataatgagactctgtctgtataaaaaaattttaaaaattagccgggcatggtggcgttcgcctgtggtctgagctactcaggaggctaaggtgggaggatggtttgagcctgggagattgaggctgaagtgagccaagattgtgccactgcatgccagtcttgagtgccagagtgagaaaaaaaatgcatattagccatttgccgccagattgagcttctgacccagaagcagtgctaatttttacatttcttcctcttatattctatgaaagccaggagaaacataggaaaggcgactttctaatcccataaaatgtgtcagagcaaaatggtaggaaccctgataaagctgacagtaaaagaagtttagagctccatgtgtacccgagatttttcttcctgcgagcagtgtaagaatcagccctatgtgattatggaaaatccccaattccagggaaggtgactcagtgggaagagagtgcaaaagaagttagagcagagcccatgatgctcagctcaccctcacaccccctccagccctgagtttgaattggaaattctgcctctgcctctgggttagtctgggcctctaatagtcttgtgagccagaagaacttcaggtcaaaggatcaatctctttcctctctcaaattttcttttctccctcttccactcccctctctcctttagacacagatgagaacctagagaagagacagaaatggagtattgtggtcaaaattctgattgctgtcaccctgttgctcagtggagttgccattatagtatttgtaatttttgaagtcccatgtcctgtaagtttgctgttgtattgaatccttgaacttgacccataaagactttcttctgttccagaggcagcttggcataaggagaaaagcatagactttggaatttgaggagatgtgccactcacactcactagctgagtggtgttgggaaagttgcttgactgttctaacctcagtggcctcatgtgtaaaataagtctcatgatatttgcctctcatggtagttataaagattgagattctgtgtgaaaggcacctggcacacaggtgctcactaaatgcagttcctttcctctgctgtacttagacattttctaggaaggataggtccaataggactgaatattttatttagaagagatggcttcctttaagttgcccaacaagaggtttggaagaaaaccaaatgcttaccagccacttcatattaataccagtcattttctcccttcagtatcaatgcctaggagccaggaagctgtgccaatgccagtggttgtggagatggcaaaagaagggaggccagccacctgggacagctgaatccaagcctgactctcagccccagaaggaaagtgttctctgtgtggtttatgtcatttgcttaaagaaggtggggtaggggccgggcgtggtggctcacacctctattcccagcactttgagaggctgaggcaggtggatcacctgaggtgatcgagaccagcctgaccaacatgacgaaaccctgtctctactaaaaatacaaaaattagccaggtggcacatgcctgtactcccagctactcggaaggctgaggcaggagaatcgcttgaacctgggaggtggaggttgcagtgagccgagattgtgccattgtactccagcctgggcaacagagtaagactctgtctcaaaaaaaaaagaaagaaaaaaagaaaaacagaaaatggggttaatatataagtgctaggagattcgtccctaagaggactgtgaaaaaatattttttttaatgtgctgggaacagggagctgcttcagttatgaagcaaatgtgggcaatccttcttatgtcaggaaataggtaggattttatcctactgttttcctaacatcagtccagacatgatacaatagggtgcttattgaatacacatacctctgggccccatataaactgaatcagatcatttagattggagtcaagaatcttacttttaagatttttaaggccaggcctgattcatcatgcctgcaatcccagtgctttgggaggcagaggcagaggcaggagacttgctagagtccaggagtttgagaccagcctaggcaacatagcgagacactgtctctattaaaaaaaaaagtatatatatatatatatatatatatatatatatatatatatacacacacacacacattatatataaatatatataattatatatttattatatataattatatataatatattatatatatataattatatataatatattatatataattatatattatacataattatatatatatatatatatatatatctatatatctatatatctataaaaggccagctgggccgggcacggtggctcacgcctgtaatcctagcacgttgggaggccaaggcaggtggatcacgaggtcaagagattgagaccatcctagccaaaatggtgaaaccctgtctctactaaaaatacaaaaattggtggggcatggtggtgtgcacccgtagtcccagctactcgggaggctgaggcaggagaattgcttgaacccaggagacagaggttgtggtgagccgagattgcgccactatactccagcctgggtgacagagcaagactccgtctcaaaaagagagaaaaaaaaaaaagccagctggtggcatgtgcctgtagccctagcttcttgggaggctgaggtgggaggatcacttgggctcaggaattgaagtctgcaatgagctatgatcgagccactgcactccagcctgggaaaaagggtgagaccctgtgtccaaaaaaaaaaaaaaattatcatttctcctgaacattggaagaaataggcctgaagggactacaaagtctagtccagaatagaattagagataaccaggtagctgcaactgtgattgaacttctatgaacacaataagctactaaatgataaaggaataaaaatagggccaggcgtggtggctcatgcctgtaatcccagcactttgggaggccgaggtggatggatcatgaggtcaggagtttgagaccagcctgaccaacaaggtgaaactgtctcaactaaaaatacaaaaaattagccaggcatggtggcacacgccagtaatcccagctactcaggaggctgaggcaggataatcgcttgaacccgggaggcacaggctgcggtgagctgagatcacaccactgcactgcagcctcggtgacagagcgagactctgtctcaaaaaaaaatagtactaagatagcaatcttatatacattatctcatttgagccttacagaaatcctggaaagtagccagggcaagtatctacattttactcatacttaagttgaggcttgaagaggttatgtgacttcccaaggttacacagctgttagaaacagaactatgatccagatcttttaattactttgctagtgggttataggttccaagcaattattggttctcatacctatgtgcaccttgatcatactttctcagtgtaattatcgattaacaaagaggcaaaatgaagtgcacttggaattacatggggttttgtacttagccagcccttttcttggtacatgaagaactatacacttgcatccttttttaactttcatatttcctttcaatctctaggttggacaagatgctgccaattcatcaaacccaaagaaagctgcagagatcactgttatccaccagacatacttctgaaaagttctgctctatctcaaagactgaatgatactacacagtcctctccctattaatatgggcacattcttgccaatttcacacttgtatcttcagcagggacattacaatcaaacaccaattcctggttaatgaagggagagtgtgggcttagcagagttaccctcatgcccctatctgagccacaaccttctgtaattcacttcatacatccatctaaatggatacctttccatcccctcaaacgagaacaaaaagtattccctgcaagcactatgaatggaccttactactctctttgacagaagactcaaacacagcctctaagaaacaaggcagctgttagtgtgacatagcttccagctcctctgttatcttcacagctgacttcacactcactggccctcaatagcttagagtgggactcctgatctccctggttgacgtttataaggttttgtaatttagcttctggtactacatgtatctatccacacactgctgaagggaacttgaccctacgcattccaaaagccttcctcataagttatccccaaggggttcagggactacagaccattagtacccaagtgaagtcttctgacgatccagaattcctaaggtggctctgatattatatcatactttaatagagagttgcataccttttggacaaagattccagagcaaaataattatgataatgctgtttctcacaggagaatagctatgagtcaaatctaacctgcttaaataagagtttggtgagaaagtgaaaccacctgatcttgaatcaatgttgaggtgaaaaaggaaatgtcaggagggataagacagggtgaggccctgcttcttttcctaagagtctgaaaccattccatttcattttggtgaaatgtgtctgtttctaagaaattctgttttcttagttctctggttaaaaaaaaaaatacataaactgtatccttctttctttcacttcaagtgctgtccaaaaagtgattatcaaaacaataccaacaggggaaaatctcaccctaaggctcgatttaatattcaagtccagcctgaaagagaacacatataaagcatggataatgaggatatgtttcaaagaagctccaaagaacctctagggccaggcatggtggctcacgcctgtaatcccagcactttgggaggccaaggtgggtggatcacctgaggtaaggagtttgagaccagcctggccaacatggtgaaacccgtctctactaaacatacaaaaattagccgggcatggtggagggcacctataatctcagctactggggaggctgaggcaggagaatcgcttgaacccgggaggtggaggttgcagtgagccccgagatctcaccattgcactctagcctgagtgacaggagcaaaactccatctcaaaaaaaaaaaaaagaaaaaaaaaagaacctctaaatgtccatagagcataccttgaaaatatagtagagaggaaacagcactgaggttggcatttggatgaatgagtatattatttgcatcctgccactgatccacgatgttgcctcaagtttattttgccatctgtgacttagtttgacaataaaataggaagaaaaaaaatgcctgctctttcccaagaccactggtgaggatgattaaaagcattatatacttagaagctcttggtccagaactgaggcctacatgcatcctcacccttcccagcctcacccaccactgaatgtcccttaatcctgaaacatgagatgtcccaggagataaaacctatggcaaaatctgcgctcatcaactcttctacaagagtataattggaggccgggcacggtggctcaagcctgtaatcctagcaccttgggaggccgaggtgggcagatggcttgaggccaggagtttgagaccagcctggacaacatggtgaaacccgtctctactaaaaatacaaaaattaggcaggcatgctggtgcgcacctgtaatctcagctactccagaggctgaggcacaagaattgcttgaacctgagattgaaccattgcactccagcctgggtgacagagcgagactgtctcaaagaaaaaaaaaaaagagtataatttgggtaacatttgtactgactttatagaaattcacagacagaatcaaaattattttgctttggggacaatttgtttcccctgacaaagcatagacccctctgaggattttctgactccctaatccattaataacttcaagtcctatattcccttccagtgaagatctgtaaaaacagagatgggagagatggcagaggagaaaggagaactcctgtgtgggctttgggatgtggatctgcagatcacttcagagctgggcaccatttctagtgtcaccattatagaccaagttatacaaaacttgataaaacactgtttctgtggaagtgccaattattcctgtggaattatttgctgtttcttttctttttctttttttttttttgagatgcagtttcgctctgttgccaaggctggagtgcaatggcacaatctcagctcactgcaacctctgcttcccgggttcaaactattctcgtgcctcagcctccccagtagctgggattacaggcatgcgccaccacacccagctaatttttgtatttttagtagagatggggtttcacaatgttggtcaggctggtctccaactcctgacctcaagtgatccacccgcgtcggcctcacaaagtgctggggtaaaaagtccaggcgtgagccactgtgcctagccttatttgctgtttctattgcaagttctttcttattaagctaccacactttgtttttataattattaaagtgcattctcagccgggcgcggtggctcacgcctgtaaccccagcactttgggaggccgaggcaggcggatcacgaggtcaggagatcgagaccatcctggctaacacggcgaaaccctatctctactaaaaaaaaaaaaaagaaaaagaaaaaattagccgggtgtggtggcaggcatctgtagtcccagctactagggaggctgaggcaggagaatggcgtgaacccgggaggcggagcttgcagtgagccgagattgtgccactgcactccagcctgggcgacacagcgagactctgtctcaaaaaatatgtatatataaagtatataataaaataaataaagtacattctcattataaaagcttttagaaaatactcaaaagtataaagaataaaagtaatacctaatctctcttcccagagataatcattaacactggttaatatgtaatcagtggttaatatatctctttatggacattataaatatatatacacatataataaaaagacacatacaaaacttcatattcttcacaccactttaaatctgtctctttggctgggtgcagtggctcatgcctgtaatccttgcattttgggaggccaaggcaggtggatcatttgagtcaggagtttgagaccagcctggtcaacatggtgaaacaccatctttactaaaaatacaaaaaattagttgggcatggtggcaggcgcctgtaatcccagctactcgggaggctaaggcaggagaatcgcttgaactcaggagactgaggttgcggtgagctgagatcgtgtcactgcactctagcctgggtgacaaagcaagactccatttcaaaaaaaaaaaaaaaatctgtctcttcttcttggctaatatattactactacatttcaagaagttgtgtttattttcaagttttagaggtgactagaagctgttccacctttttttaaattttaattttttgagatggagtttcactcttgttgcccaggctggagtgcaatggcgtgatctcggctcaccgcaacctccgcccgggttcaaaccaattctcttgcctcagcctcccaagtagctgggattacaggcatgcaccaccatgctcggctaatttttgtatttttagtagagacgaggtttcaccatgttggtcaggctggtctcgaactcccgacctcaggtgatctgcccatcttggcctcccaaagtgctgggattataggcgcgagccaccgcgcctaggctgttccacctttttaaagggttgatgtcaccccaatactttttgataggcccaaaaattaagataggtagttgcttagggcaaagaaggtacattcacaaaaacctccaatttaaactttttaagttattgctgaatgacattaagtaaacagccatatttgcgtgtgtattaaaagcattactttgttaaacagaaacacttaaaatatacaacagccaggcatggtagctcacgcctgtaatcccagcactttggagggccgagtcgggtggatcatctggggtcaggagttcgaggccagcctggccaagatggtgaaaccctgtctctactaaaagtacaaaaattagctgggtgtggtggcacatgcctgtaatcccagctactcgggaggctgaggcaggagaatcgcttgaacccaggaggcagaggttgcagtgagctgagatggtgacactgcactccagtctgggtgacagagtgagactccatctcaaaaaaaaaaaaaaagataaatataaataaaatataaaacatattttgtatctctgttttgccatttcttcattttttagataaacccataatctcaaaaatcaaagtgacctgggactgtggatctctgaaaggcctgaacaagccattaacatccttccttttctgtactcccaggctagtgcaacggtggtttcaggagtggtactggccttaaccattatttcctcatatctcctaccccctcctattaatattttggatgctttctaatcactgcccagcagattctgacctagagcacttttcctatgtctatgtccataactagccattttccaaggaagagttgctgcatgtacttatgactaaaggccagaagaaatctttttattttttgtttgccctggacaggttgagagtcctatgatcccttcctccccatcccactgatactccactcccactttcaaaaagtattccattttctgagttgacacaatggccctcaggttgccttgaattacttatcttccctattattagtaatagtagtagtagtattatactttaaattctagggtacatgtgcacaatgtccaggtttattacatatgtatacatgtgccatgttggtttgctgcacccattaactcgtcatttacattaggtatttctcctaatgctatccctcccccatccccccaccccacgacaggcgctgatgtgtgatgttcccagccctgtgtccaagtgttctcattgttcaatttccacctatgagtgagaacatgcgatgtttggttttctgtccttgcgatatttgctcagaatgatggtttccagcttcatccatgtccctacaaaggacatgaactcatcctttcttatggctgcatagtattccatagtgtatatgtgccacattttcttaatccagtcaattacttatcttcttatatgtacttactggttcttctgcttgaagcccagtatctgtgttaatttgtatatctctatattactttgtatcaacaaagcaccatgttcatagcagatactaaaaatatttgttgataatgtcacaccaccaaatggataagctaagggtagcatagctgactttctagaagagaatgaagtaagctttatttttatatcaaagttgctatcagttaccagggagatgcaaaccagtaaagggtcatactataattgttgctaacacttgaattcatctctttagacttattttccctcatatttcatcatctgttcctttttctcttcctcttcattattacaacacttttcttttgtctttccttattcaatgacctgatttgtcagtgatcaaattctaaaaatttccctcaatctgaacttctagtgaacttcgatccatgtttatactgaaatttcagatccaaaaagtctttcctttaccccaccctccttcacttggtgcagtgtagcaacaggtgcaccttggaccgtaattgaggaactttcactggactcttgtgaatttgcaccatccagtggctgaaattgctaactgcatcctctgaaaaaaggcagtgggcacaaataaaaaaatgtaaaatgggggctgggcgcggtgactcactcctgtaatcccagcactttgggaggccgaggcaggtggatcacaaggtcaagagattgagaccatcctggctaacactgtgaaaccccgtctttactaaaaatacaaaaaattagctgggcgtggtggcgcgcgcctgtactcctagctactcaggagcctgaggcaggagaatcacttgaaccaggtaggcggaggttgtagtgagccgagatcgcaccactgcactccagcctgggtgacagagcgagactctgtctcaaaaaaaaaaaaaaaacagtttggcctcctcttctagctgttgtggtatcactttttttttttttttttttttttgagacgaagtttcgctcttgttgcccaggctggaacgcaacggtgcaatctcagctcactgcaatctccgcctcctgggttcaagtgattctcctgcctcagcctcccgagtagctgggattacagacatgcgccaccatgccctgctaattttgtatttttagttgagatgtggtttctccatattggtcaggctgtctcgaactcctgacctcaggtgatccgcccaccttggcctccaaaagtgctgggattatgggattacaggcgtgagccaccatgcccggactttttttttgagacagagtctggcactgttgcccaggctggagtgcagtggcacaatctcggctcactgcaacctccgcctcccaggttcaagtgattctcctgtctcagcctcctgagtagctgggattacaggtgcccgccaccatgcccagctaattttttgtatttttagtagagacggggtttcaccgtgttggccaggctggtctcgaactccttatcttgtgattcgcctgcctcggcctcccaaagttctgagattacagacatgaaccaacgcggccagcctgtggtatcactttttaactcctctaactccctccctctgttctagaaagaaaagaatttgattcgcatttccatgctttcaatgaaatcctttcactccaatgaactcattcttcctggtagattaattttaagccttttatctctagctatagataataataatagctaatattcgacgcacatttactatgtaagaattaacgtctttgccttctactaaagtaatgttaggaaaacaagtgggtttagggagcatatcattggcctgaactaccatatcctcagaatctgtctccccatacactctcttgcctcagtttaatctgcatacaattctccacattgtaaccagtttttcaaaatacagatttgatcttgttactcttttgctaaaaaacttttagtgaattcccactgctatcaggataaagtacaaaaccctcaagacgactgccaaggccctagataatctgcctctctccagtctcctctgccccactcttccccttctctagcttcagtggcaatggactagctcctttcctgcctcaagtcccatgctgttctgtctgcctggaatattgtttctactctctcatcctctttccccttcttcactactattagccggtttaactttccactcttccttcagatattggctcaatagtcacctcctcagtctgaccttctaaactccatcagattcttctatactgttttatagtgtaaatttccttcgtggtattcatctgttggtaattatgtgttaattatgtgttttggattcaaaagccaagggaggctgggtgctgtggctcacgcccataatcccagcactttgggaggccgaggcaggtggatcacttgaagtcaggagttcgagaccagcttagccaacatggtgaaacctcgtctctactaaaaatacaaaaattagccaggcattgtggcgagcacctgtaatcccagctactcaggaggctgaggcaggagaatcgcttgaacctgggaggcggaggttgcagtgacccgagatggcgccactgcattccagcctgggtgacagagggagtctccgtctaaaaaaatggaaaaaagccaagggggacattcaggtcagagttaaacagatgagggagtgagcaagagattgatggaaaattggaagccacaggagaagacaagattgcttgaactcattgaatggaaaaacacaaaagaaggaagagtgaagaacagaaacttggatgacaacaggtaagacagagaagagcccattaatccagaaagggagaagtagatttaagagaaagaagtagcagtaaaggtgggaggccaatcatctgaggtcaggagttagagaccagcctgaccaacatggtgaaactctgtctctactaaaaatacaaaaattagccgggtgtgctggcgcatgcctgtaatcccagctacttaggggactgaggcagaagaattgcttgaacccgggaggcagaggttgcagtgagccgggacggcaccactgcactccagcccgggcaacaagagggagactccatctcaaaaaaagaaattagaataacaggagttagttttaaaatttaaatattagatggcattagtctgataagtatctctataatatagtggagtataatggggtaataatgcctgaaatgcactggccaaggctctcttccttgaatgggcactaagtcagccccagccctcccattacggttccattactgactaacctctctctttttcaggttgattcattctccctttggatatgctatatatattctgtatttttcagagccactctgtctcctaaactaactttacatatctctgctgtgatccattaccttctgagacggtatagtgtcagggattgtggtagtagtctgaatctccactatgctgcctacttacattctcttaagtatcagtctctgcatcagtaaaatgggagtaacaccataaaatacgagtaaacccgtagagggtttcttagggattaaatgacagaatatatacagaaagccttgaatagtagctattttcagtaccaagggaaaccctgctgtgtcattttgaatagtgtgtttgtcactgcatgattaagtagtaaaggatttcagataaactgttgtctttggcatgattatagaatctagaaaattaataaaataagcaggcaaaagttttatgtgtttggctgtgtaaaaataaccaattacagtcatttatgtaaacaatttaacgtgtagggcctaattatcatgcaacaccataacaattacatatattattaaatatgcatcagattaaccttgttgttaagttttgattacaataaaagtactttgtactctaaggaacagtcttatagttaattgctaataatgcataagtttgttcactatttgcattaattaaatgagacatagctcctgagtttgctctccatttgaggcaaggctggatcctccatcctatattgcaactacacatttgtcctgcgacctgtgagataacatacactttccttagtattctatagtgaggaaaatgctgaagaaactgccagtaaaaaaaaattctgtttaattggctgttgttcctgaacctacaggtttccagtagataagagtttttgatttaaacaatgaaaaattctatgctgagcactagttaacctatgtagaacaacttctaaataagccccaggatcatcctgtggagcacttctataaataaaattatatttgactcccaccatgaacaaggtagtagtatacatacatatatcatcccaccccaccaccttttttttttagactgagtctccctctgtcccccaggctagagtggggaacagactgatcatgccttactgcaacctctgcctcccggattcaagtgattctcatgcctcagcctcccgggtagctgggattacaggtgcatgccaccatgcccagctagtttttgtatttttagtagagacagggtttcaccatgttggctaggctagtctcgaactactgacttcaagtgacccacccacatcagcctctcaaagtgctgggattacaggcgtgagctactgcatcgggctttcatcatatccttatgaaacgcttatgaattagacattattattttcattttacataggaggagaaaggagatgcaggaagataataacttccctaaattcttttttttttttagatggagtttcactcttgttgcccaggctggagtgcaatggtgggatctcggctcacggcaacctctgcctcctgggttcaagcgattctcctgcctcagcctcccaagtagttgggattataagcatgcaccaccatgcccggctaattttttatatttttagtagagatggggtttcaccatgttggctaggctggtctcgaactcctgatctcaagtgatccacccgcctcagcctcccaaagtgctgggattataggcatgagccaccgcaccaggccctaaattcttaaaggtgataaggagtggagacagaattcaaattcaggaaagtttcaaagtccatgcttgctttttcaattatattaaacaatgccaagttccttgcatattccaagcatttattgggcacctgttggttgcacaagagtatagactgcctgtcaccaaatgatgcaaaataatttaggagcctgttttgacagtcacaagatggaggtcctgtacattaggcagaaaagtatgcagctaggcagcctagtaggcattttagaattgtctgataaaccgagccacttagcaacaatatatttctagttcacctaattttttgggttctgcccaaaggctggtgactcatgagacagatattccgcactctgtgtacatgagaaagaagtcagtaaggtgaggaagaagcagaagagatgggtaacgaaggcctggattcacgaaaactgtttaatggccatggtattatgaaaatcctgataccagccaactcttgagtgttaaataatgagagtcagtttattagttatatttggacagatctggttttttgctttatttttataaataatgttctaagaaatatattttatttaatttacttatggcatatttaaacattttttggcaaataaaaattgtgtatattcatgatgtacaacatgtgttgatagacgtactcattgtggaatggctaaatcaagctaattaacaaatccattacctcaaatatatacccattaccgcaaatacttatttttttgtgtggtaagaacaactaaaatctactctcttagcaattttcaagcatatatatatttttgtttgtttgtttgtttttgtttttgagacagggtcttgctctgttgcccaggctggagtgcagtgatgcaatcttggctcactgcaacctctgcctcccgggttcaagtgattctcatgcctcagcctcctgagtagttgggattacaggcatgcaccaccacgcctggctaatttttgtatttttagtagagatggggtttcaccatgtgggccaggctggtctcaaacccctgacctcagatgacccacctgcctcagcctcccaaagtgctgggattacaggtgtgagccacagtgcctggcctcaagtatatatttttaactatagtcaccatatagtataatagatctcctgcacttattcctgctgtctaactgaaattttgtatcctttggccaaaatcttccaattctttctctctcatcccctggtaaccaccattctgctacttctacaagcttgacttttttagatgccacacataagtgagattaagcagtatttgtttttctgtgcctggcttatttcactttgcataatgtcctccaggtccatctatgttgctgcaaatgacaggatttccttattttttaaggctgaacagtattccattgtgtgtgtgtctgtgtgtgtgtgtgtgtgtgtatctatatctcacattttctttattcattcatccattggcatacatgtaggctgtttccatgtcttggctatggtgaataatgctgcaatggatatgggagtacagataccttgacatgcagatatcatttcctttggatatatacccagaagtggattattggatcatatggtagttccattcaaaaatttttaaggaacctccatactattttccaaaatggctgtactaatttacattcccactgacagtgtacagggtttttctccacatccttgccaatgcttatctcgctttttgataataatcattctgacaggtgtgaggtgatatctcatggtagttttaattcacatttccctgatgattagtgatgttgaacatttttttcacataccagttagctatttgcatgtctttttcttttgtttttcttttttttttttttttgagacagagtcttgctgttgcccaggctggagggcaatggtgtgatcttggctcactgcaacctccgcctcctgggttcaagtgattctcctgcctcagcctcctgagtagctgggaatacaagcgcccgccaccacgcccagctaatttttgtttttttagtagagacagggtttcaccaggttggcccggctggtcttgaactcctgacctcaggtgatccacccgcctcggcctcccatgctacttgcatgtcttcttttgagcaatgtcttttcaggcccttgtccacttatctgatgtaggggtcgtgaatattttctcccattccgtaggttgtctctttaccttttttttttttttccagacgaggtctcactctgttgcccaggctggagtaaagtggcacaatcacggtcactacagcctcaactgtctgagctcaagtgattctcctacctcagcctcccaagtagctgggaccacaggcgtgtgctatcatgcccagctaattttttgatttttttgtagagttgaactctcactaagtcacccagtttagtctcgaactcctgagcccaagcaatcttcccacctaggactgtcaaagtgttgggattacaggcatgagccaccgcaccaggccagaaactctacgtttgattctaaccacagcagcttagcagctgaggacaaactgttgggatattttggtctcagtcaatggcagccaggttaccaaccctgacaagatacaagttttcttcgttgggttcctggtacaaaagtcaaccttttcagttagttatgaatgaaagggcatgaagattgtgctattagtttatcctgaaggtcaatcttcaaaaatactggttcaacatggatttggatattattaatataaatttatggcttaaagaggacaaaaggtgtttttttgggttcctttacagagatatttagtgagggaacaaggcacttagtcatctttgctatgacaggttaaatacaaggtgtactgggaacatgtaagagggtgacttaactcagccattggggggtcaggagaagtgttcctaaggaagtgatgtctaagtgaggtaggcagtaccttggcaaaaaaaaccttgaagttaagagtgcatatgagaaatgaaggtatgtccacctggctggcaaatggagtctaagatagggcagtgatgataaagatacaggaagatgctagatctggaagggccttctaaaaagaatgacaatataaatttattgtacaaatggagactttactgagagtgaaaccaggcaatattaatacttaggtagggacaacagatataaaccaggctattctcagcaaatcagaaattatggtcaccctacttgtaagtcacattcaggtgcttagactttcagtgaaagcatagagtatgtatcttctacattttgcctaagtgacttcattctttttttttttgagacagagtctcgctctgttgcccaggctggagtacagcggcacgatctcagctcactgcaagctccacctcccaggttcacgccattcttcttcctcagcctcctgagtagctgggactacaggcgcccaccaccacgcccggctaattttttgtatttttagttgagatggggtttcaccatgttagccaggatggtctcgatctcctgacctcgtgatccgcccgcctcagcctcccaaagtgctgggattacaggcgtgagccactgcacccagccagtgacttcatttttacttttgcctttacttactcatttcacaagtatttgaggatacacttcagagcactgaggttacaaagacaacagtgtctgtcctcaaggtctgtctaggtaagacacacagccaaataaacaattctaatacagttatacagttttagttctgacacctccaatgagctgtagacttgtatttgtcatttccagtcagaatgcaaaacacagatccaaaacagaactttcaatttctcctccaaatctattcttccttcagctggtcgtgtaagtgatgccactatcacatccacttaagacaaaaacccagaggagtactgccttaatcagtaatcagtgttacccttcttctcactgtgcatgttaattttgccacatcttttttttttttttttttttggtacagtgtctcactctgtcacctaggctggagtgcagtggtgtgatactgggtcaatgcagcctcaaccctctgggctgaagtgatcctctcacctcagcctcctaagtagctgggactacaggcatgcgccactacacctggctaatttttgcaatttttgtagagacgaagtttcaccatgttgcccagttctcatgcctccttgaactcctgaactcaagtgatctgcctaccttggcttcccaaaatgcagggatcccaggtgtgaggcaccgtgtcctgccctctccacatctttcttaagcacactgactaaattggtctaagtagagcctaacatcaactgaagggagagggtaatttccaggtagttgaatgctatgatttttgtttttttgtttttgagacagactcttgctctgttgaacaggctggagggcagtggtgcgatttcagctcactgcaacctccacctccagggttcaagcaattcttgcgcctcccaagaagctgggattacaggcatgcgccaccacacccagctaattgttgcatttttagcagagatgggttttcgccatgttgcccaggctgatcttgaactactggcctcaaatgatccatctgccttggcctcccaaactgctgggattacaggaatgagccactgtgcctggcccctgaatgctatgtttttaacgactagatctcagtattatgtgggactaatttttctacagtattacaacactgattactgatattcattgttgacaatcatgacatccagatctggatatttgccttagccagtctcaaaatttgagtttcaatgacaaagacacagatatgtcctaaatgactgaccccacttccactatgtgaagttgagagtggttgtaaagctgtacagctataggtgaaacactaatgttaatcaactatctgttgaacaactaccatgtaaaaggacaatttatgccttagagagcaatttaaaatttttttagagatgggggtctcgatacgttgcctagactggtctcaaacttgggctcaatccatcctcctgcctcagtctctcgagtagctgggattacaggtacacaccacttcaccaggcaaagggcaattttaatatttctaccatccattctccacacagctgccacagtgattttttttttttttttttttttttgagatgcagtttcactctgttgcccaggcttgagtgtagtggcacaatcttggctcactgcaacctccacctcccaggttcaagtgattctcctacctcagcctcccgagtagctgggattacaggcgcccgtcacaatgcccagctaattttttttgtatttttagtagagatgaggtttcaccatgttgaccaggctggtctcgaacttctaacctcaagtgatccgcctgcctcggcctcccaaagtgatgggattacaggtgtgagccaccgctcccagcccacagtgatccttttacagcaaagctactcctttgctctcaacccttcgtcatattctgtcacttcccaataaaatccaaaccttaccagatgatacatgatctgccttgatttccatctaatttctctcatttgctgtgctccagccacactggtcttgccctttctccatgccaaacaaatccccatttcagggtcactgcacttgctgcttctcttctaggatagtttccctctagaaatccatgttgctccttctctcattaaatgatcagatatttatgtgcctccttagctaagaggccttccttatctaccctaactaagagaatccccatatcactcttatccttttatcctgatttatttttccataaaacttgccacattactgggcattatctatcatttagtaatgtgtatattgcttattgacagtcttccctactataatatgagctccatgaggcagagactttgttttgttcactgctgaattcccagcacctacaacaagcctactcactaaacatttgttgaattaatcttcaggatacatcaaatgtaaaatatcctatcatatatttattgatgtgatgcataggaaaatgtctggaagggtacataccaaaatgttaattatttatttaacctggtgggaggtggtttttctttccttttcttttctttttgagacagagtttcgctctcgttgcccaggctggagtggaatggcaagatcttggctcattgtaacctctgcccccagggttcaagcgattctactgcctcagcctccggagtagctgggattacaggtgcctgccaccacacccgcgtaattttttgtatttttagtagagacgggatttcaccatgttggtcaggctggtctagaactccagaccctgtgatccgcccgcctcggcctgccaaagtgctggaattacaggcgtgagccaccgcgcccggcagggcttttttttttttttttttttggaatgaacttgtattatgcatataccaaaaaagaatgaaagggttcacacaggtataaagtgtaagtgaattctaaaaaaaggttgggcaaatttatcaaaggcagacttctaaatagatgtaacagttatatagttcagataaaccatggtttgaattcccttccccagtacttcctagcagtgtgatcccaagttatttatgtcagtgcctagatttcttcacctggaaaatagggataacaacaggtgcctacctcacaagttttaaatgagaccgtatgtgtaacctgctttgtgcaatgtctggcatgcaataagtactcgacaaatggtagctattagaatcatcattaacagcagtaataagagatcttgggacatacctagccctcaagattgacatcagagtagaccaccacatcctctcatcattgcgcctcaatttgggcctctgaagcccaaagaggggatggttctttccaaagaagacaatttcgacgttccagaagcatctgattgaaacgcaccctcttcaccccttaaaatcagtctggttcatccacgagcagcccttcggggcccggactggagaggcagccacggctcgccgtccctgggcccagttccctcagcctcaatttcccttgctgcaacaggggtggagatgggaacgttatccccaaacccaggcagtcccggctcggcccgcctcaccgcactccggaggggaccaaacagccccacgcgccaggaagcctcaggcaacgggccacgcgccacacgggcaaagtgattactggtcggatcaaaagtcaggcaagcggctcagccccatcctcccagtcctcgggcacggggacagcagcaggcgcgcggcggggaccgggaaaaggccaagagggcggtggcgggcgctcagcacccggcgggggcc

SEQ ID NO: 1159 - DNA, 274133 bp, Homo sapiens
tcttctacaaatgtagaggtttatttcaacaaaatgtgtaaagagtgcatctgaagctcctgctcatcacagtatgtgtccatcaaattctgagacaagtgaaggctgttttgtgaacgaagagaacagataatatggcggtctccgtccaagcaggtcttggtcaatatccatcatttatactcctcctgccttagtagccttgcatgtttgaggggctgtgggaatgtcagattgctcatgttctgtgcctccaacttgaaaaaatccttgtccagggtaagacctacagtaaggagctctggggatgggggaggaggcattacagggttctagagaggaaacatactcgtttgtgtcataatttggtggggagaggggaggtaaatgagtgtaacccaccctgcctctgaagacatgcctggacaggcctcctggggggtgcaggacttcataccacttgtagatatgtgggatttgatttattgcaaaaaagcatagaagaataatctggtcaaaaatgaatccaattcttactaggtaagcaaatagccagcaatggtcaatgcattttcctggactgagaattgtcccccaccactttatgcccttttctgaaggtgctgaacacctgtaccttccaccagggcagccgggctgaggctctgactcctgggggctgtccgctccatacccagccatacagtgcccacctgcaacccagaaccattgaaaagtccagccaatctatccgcacagattcctcctgaagaaggggaggtggagctcgttcttgtgtgcaaactacagggttaaggctcagaactgtggcttgtccaagaacgttcataccactgcttctcaaatgtcttagtgatttcctccttggtcatcagtgacaaatgcagttagctgcactaaaggaaccggatgctacaccagccctgatcacctgccactcttgctttaggaacagaggaatcagtaagttcttttcttgaataaactagttgttgaaagtaaactctctccaccacctgaggaagcccctgatgccagtcaggaggggccagtaagcctggaggacagcagcaccatgactgagttgtaaataatcttaaggtcatgtggattctgtgtttcctggaagcctccctcatcaggaaggccagctcctggtgctgagggtgtagctgtcaccagggtcctttcagagctgtggggagacctgctgcctgtctacactctggggaagagagtagaaccgttagctgctaggacagtaatcctggaactagggaagagtgagtgtggaggcaccattaacctctcaaaaccatccaagctccaggcttcataggaacaactttccaagtcctcaaaacaaacagactatctatctatctcactggctctccacatggcataaataactagtttccaccagtgcagaaagggcagttctcttctggctcctcctctgccaactcaggcttcaccacctgtggaactgctggggcccctcaagcactggccttgcagctcccagccacatgcgacagctagtccagcagtgacgtgcaggcgagaggcaggccaacaactacctttccctttgtcctcagagactgaacccaaggttgaggtcccctaaatcaagaataactggttctattttctttctctgcttcttggctcacagttttgccctcatctttgagttcctatggagcttgtagtagattttatgctctaatttttcttcataaaaggtaccgtagtgtggttaaactgggaatcattcctctccagtgcctactgtgtgctgggctaagagtcggggtaataaacaatggacttgaggcttcctcctctccttagccctcctctgctgcctgtggctgcggctcatggggccaggagtgaggggggctgctcactgctgggcaactcctcacgcttccccatgctgggaggccaaggggctgtcaggacaggaggggcagccctactttggttagtaagacctcatggtacatgtttgtacctttcattgccttctcagtcctgtgcagggagtggaggactaggcctggccagggtaataaatactgaatggggtaggtgtgactggtgggctggagggggattctgtgatcttacatcccaggatgtcatgcataacctgaaacgagaggaagtaaaatgccatttgactccagtgctgggtctcctgtgccttctcattacagtggttacagttgtaaaaggcagctctagcccttttctccagagacagggcagggacaggcaggaagctcttcctacgtggaaggggaatccattgtggagaggatccgtatgacttctgctcgctgagtgggtgatatgtgctgcgtcatatggatgatggaatccatggcaacctctggattggcctggaccaagctggaaaggaagattgagaatggtgaagaaaagagaagcagaagtgtctagatgaggacagctaaagaactgcccaataaacatgtgtgcaccgtccactgcagacattttagtcacgcctcaccttatttgtttccctatattacaaatatccagccaaggtagtgcaagacaaacccaaaacattttgctatgttgaaaaaggaattaaacccaaaacaaaacccaaaaaaaacccaaaacatgccaatgggggcatgtcacaaagacagcaattggggcatcaaaagcagcccagcaatgaattataaatcagtaaaaaatagaacttcatgagtctgtaccaataatgtatatataaaagaatcggcaggagtgaggactgagtggtgactggtaattgtggagggtgtgctggagttggaaagttatcattttgcaagctcatcgtaaagactgcaccagagggaaattttgatgaaagcaagatacttgcatggccttaaaatgtcttcctgcagactacttattaggtgcaaggggggaaaatcagtaattatacggtagagaaatggagcaacatcttgaccagcggatgaaattaacacgaggaggagcagataaacagcatgtgcccccagatgtggtgccctgtgaaggttctggccagagtgcctcacctgcatctcatcatggggagacatcagacaaactcaaaatgagcaatgttctacagatggtagatatcagataaaagtttttaatcaatgttaaatttacaaaagtggatcattttatgatggttatgtaaaagtatccctattctcagcaaatgcacactgaaatatttgggggtaaaggccatgatatatgtaacacccttaagtagttcagaaagaggaaaaatgtatacacatatgggagggcaggcacactcataagtgatatagcaacggggagaaaatgtaacaggtaaatctgagtacagatattatatataggggtgttctttgtactgtttttaattttataacttttctgtaagtgaaatgtttccaaataaacttttacaaaaatgcccctgcagtctctaccaccgatcctatggagcagactgaagcctctagaagaatacagctaactcttggcttcaggaggtgaggaggtggtttcccaggaaaccaccacacacacaatcagctttcctcccagagttgttcatccggtttgagtatcagcattcagagctaagaggtgggcacagtgaattaagccttcatctagctgagattactaagtgcccctggggagcagtagctgaaaaagaattgggcttcaggccatatctgtacctgtgggtcaactacagctgtctcaaacagcaagagactgcagagatcataagatttctgcgatcatctcatgatttgtttggaaactttttattccaaagaaattagccctccttctctagtggagttccccacgttggtctcacctgcggatttgcttgaggacgtagtctctgctgatgcatttgatgttttcctctattaccgagtgaacaccatcctcctctgtcagctgtttctctagccactccgccagatccttattattgtcccaaacataagcctgcaaacagatgactcttggtcaaacaccaggggtcaggccaggccgggacaccctgactattcaggatctggagtgcttgcttactccaaaagtgtgctccgtgtccacgattctccttcactgtcagcatcgtgcaggaggaggaagtaggcctcgaggcaggagctgtgccccttctccttctcttcctttatggacacaggtgtacacctgaagtctccatggggctctcccgagcactctggtgctcataccctgactctgtcctgtcagactctagggacccacctatttgacaaaggctaagagaattcaataacctgacaggtttgagagaaccagttaaaagcccaaattacttagtaaaattgtgattgagaaggcaaggctgtttatttggtgttttgctctcagaggagctgagacacaatgcctaaagtataagtctctagcctcagtgaggcctggcagtcactggatggatgaagtctcctgaaatagagcccactgtcttttgatgaggcacggacggggaactgatgggagggaagtcttgttgccagggtacagccaccaggtcagaaacctaagccccattttattacctatgagagtattcgaaaggatcaagacgtccataaccctgaaagtctcaacaaaccacctctcacctccttttcaagatcatttagctgagtatttcctaggtggttgactacataataattcaggagtgtgttagaagcctaatagccttctccttgctctcttctcctctcattttctttacaaatcatttaggaatcgttttgttaatggtttccggaaaaccaagtaccacaattagggctcattcatatttatgtcattttgtttgggtaattaaacacaaagcttgtcatttaaaggtgcgctatccttctctgttatcactaacgaagtcaaagtcagaatgacaatgagtttggtgctataatttaataggtgggtgtgtttgttagggactctgaggctttgaggtttgagacgtggctacaggaagcctgtatgcaagcaaggtcaccaaagccacagctgtgactactgggctgcagaggaaatgtcttcatcacaagaggcctcaagcagtacaaaactgagcactaggctattttctaactatctcgtgccttcaaatataatggtttcttttcagactgtcacttcctgtctctaacttagctgccgacttagttgtgactggttatttaatgtatgtcatttcatcgacgtctctgtttctaaaaattaactcctttacattggaaagatgaaggcttccggggactaaggatcagcagtatgtctcttttagttctttgtccatttctttttctgactcaaatgtgcccagttctgtatctaatcactgataagcagatcagcaattcttcagctggggtgtgtggccccgtcagtgcaaacctgagtgaccctctcctctctgtgcctgggttaggactcccagcatctctcaaggccaaactgccttgagaaagtgttttgcgcctaaggaaaggaagtgtcacatcagcccctatccacgagggagaaggtagcactgcttttcccataacatggttttaactcactcttgtgacccagcttgctgcacgccccacatatggatgggtccccctggactcctaaacgtcgccacctaaatttcaacatttccatttccatcattggcaatttactcttctgctccgtggtttcaggacttctacacatacccctacttatgaagattggggtggaggggaggaaaaataaaacaataaatgcttcttggatttcagaatggaaaaaaaaaaaaccccaagatttttagatttacccaagaatcccaaagcctttagtttaggagaatatttaatactcttattaatcatttttaatccgtttgcttttaattaagaaacagcatgatgctttcctatcaacatatgccagggagcagattaattgtggcttaagataactctccttgattggtgtaatgtattagctaacgagatgcctgcttccaacaatgctcagacactacactggaaagccagctaccctctagagaaaactcttctgccttcccctcctgcagccacagagtatgctaggtgtttaaacattttgaaaagttcccagacaggattagggcaacgcattccaagttttacagttgcttgaaaatatgggtcctataaaaagatctgctgtttacgcaaagtacaactggatgacaatgaccgccaaaccccagtggattacagcctagagtacatgaaggaaaggggtctcaagttctaatcaactgcatgtttagcaaaaataaacaaacttatgtaagcatagtgccactggtttttctcaacagacctgggagagttaccatactgttgtgggataatttgctccacctgggaaaagcaagctcccttccactgggttatggagtttacaggtttttttttcttcccccagacagggtctcctcctgttgcccaggctggagtacagtggcatgatcacagctcattgcagcccgaaactcctgggctcacgtgattctcctgcatcggcatcctgaatagctaggattacaggcatgccccaccatgcctggcaaaactttttttggtagaaacagggtctcgttatgttgcccaggctggtcttgaactcctgggctcaagcagttcccctgccttggcctcccaaagtgctgggattataggcgtgtgccactgtgcccagccagagcctacagtttcttgtttgctcccttagaacagttgtaagactcaattccagtcatccagaaggataggccaaccttattcccaggaagaagccattattatttccctccttaaaattatgaaaatgggcctggcacagtggctcacgcctgttatcccagcaatttgggaggctgaggcagggaattgctggagtccaggagtttcagaccagcctgggcaacatggcaaaaccccacctctacaaaaaaatcagccaggtggggtagtgtatgcctatagtcccagctacttgggaggctgaggtgggaggggaggatcacatgagcccaggaggttgaggctgaaagtgagtcatcatacctactccagcagcctgggcaatagagtgagacaaaaaaaaaaaaaaagaaaatgtggccagtcattcctagtattccagcgtggactttaaacaggtgtgatatgctaggctgctaacatcatgacaggcctgggcccgtatgccacctgtcagcatatccatctgtatcagaacattttatcaataaaatatcaataattctacatcacaacagtggcctgtcctaaaatgaatgttcaacagacactttctgtctgcatcagtggataagtatctcaggcactagtcagcctcactaattttatgtagtaattagtctatctcacaacatctaaatgacctgtttggaaagtttcatttctaacatactggatagctgttaagtcctccttagacaatggttcagcagggccaaggagtgaccagggcacaacctgatggatgtgagccctgattactataccctactaataactcaccttgggagctgctgggagacacctccagctagggaggctcctcccatttctgaccttctagacttctgggaaacacacagcctgatgggtgtagggatggcatacaaatcctaaggtacactcatattttggaaagacattttcaatacacctacacttacaaggctaagccctatccaacagaagcccaagaaaggatgtgatttttttttccaagggctttagagtacaatagccaaaggacatgtgggctagggtggccatcagacccctgtgaaccaagctcctgtgagccaatcccatctcagctccaggcccatagcagggccaagcaacactttccaggttctaccttacctcctccctgcctggccctgtgtgagaagtttggtgtatgagacttattcatcagtagcctgaggccaggttttgaggtcagtggaaataagtgaccctgtcaatagtgctttttcctatggtcctcacaggggcctctgttgagcattcatttcacttggaaatccagaataagagcgagtgggtagctgtgtgaacaataagaatgcaccatggcatcgggttgtgggaacatgagagcatgccaaaccaaagagcgtctgagcacccactgtgctcaggagtcagccccctttccgccgaggtcaatcagctgtacatttttgacttggtctatgttgctattatttttttaccttctaacatggagcaggggaaactagcatattttgaatgtctactgagccagacattgtgttccatactttttctttttggagacagggtctcactctgttgcccaggctggggtgcagtggcgccatcatagctcactataacctcaaattccttggcccaagcgatgctcctgcctcagccccctgaggagctaggactacatgtgtgtgccacgacaccgagcaaattttaaaattttttgtgaagacagggtcttgctttgttatccaggctggtctcaaactcctggcctcaagcgatcctcccacttcagcttcccaaagcactgggattacaggcgtgagccaccacatctgacttatgctccatactttactcatgttatttaaaactcactgaaccccatgacataaacaccacccccattttacagatgagggaatggaggcttaaataatatgcccatgccagtaaatgacaaagctgggatcccgaagtttatgagatttcaaaacccacattctcattgttccatgcagagtcctaatttcaatttctactattggggtctgggaaaaaataaatcagcctgtttgaaaaaccaggcttcaaattttggatctaagaatcaagtgagaaaccatgcccaggatacaaatgtgtgccatgttcttatgacccaatttaaactactgttcttgttattttcgttaaggagctgtagtgatgctttgcttctgcctgcagtgaaactatgaaccataaatcctactatttcctacagtaggatcgtcccagtggattcaaacagactcccataactcatggtaacagatatctctaagggaaacaaaagaattatagtgctcagttatataatatcaccgtgtcttcaattttctgtcccagaatttctgttttcaggattaagattaagaaaacaaattctctgggaacaaaaagaacacaaggcatagctaatagatgcctatctcgaaatgtcttttcttaccagtaaccaaccacaataaggattagagggtcacttcctggtgcaaagccagggtctagactcagccagtctttgcacttgagaaacacaacacacagtatctatcattctttgaagaaccacccccccccccccacaccaaacagcaagcagattgtacatcactccttctgaggcacacagatggcttttgaacactgcaaccctttcttctctcaagggcactgcagattttatcacccacctcacactaaactaggtcctgctgagcctgccgaatatggaaggaggtttcaaagccacatgccctgacatcataggattacccgtcctcacgttcagtccttggcattcctctcagagaactcaggagaatgctgccttttgtagatgggcacaagggaaatggcctcagtgctcagcatggctgcccccagtgcctaggcagcctcctactgagctacggggtggaggttctcttctgtgcttcaattccagccaggagcttgtacacacgtggtcaactgttctctccattgataagagacggcagtgacctatttcttcagacgctctgtccgcttgggagcaggatgctagggaaaagctgaagggcctatctacttgcttcatgcctggggggaaacttccttctcatccttgtgcctactgaggctggacacgtccattagtgactaatgtggtagggaggcagtgcaggcctctcctggccacacacatacacacacactccatttacctagccggccactcttaactggaggacaaactcttattttacacttgcgtgactttcaatgccaacttccactagaagctgccagtagccactgacaaaattgtctcactcaattatgatgccacagactgaccttaacctgaaccaaatgtcggagaaggctgtgctccccaactgcacatttgaaatatttatccaaagaagcttttcagtcataaaaaaaatgggcagacttaatacaaaggtgaatcctagaagcaccccaattcactggctttaaaactgacagcaaatctgggagctcctccttgagaacgattagcagaggcttcaggcaacactttctaggcagaggccagagtgcccctctttgtgggccaggacccttcaagccaccaccagccacccagccctccatcaatactctaacctggtagtcaccaaatgtttgtgatcacatagcaatgagaaagacagacaaatatattttgagcacatactaccaatattctgataaaatgcatttttgatgtaaatgattaatccatatattaattactaataaaggttaatttctttttgttagtaaaaataaacagaaataaaagttccagctttttcttcccatccatggagtgacttatgcagcccactattccaggagcaaatgctggtgcccttgctaggtcatcctggcttgagacccgccccatccccaacactgaggctagagcaccaaggacaccatctcagtggggttactgctctaggtcacgagccctctctgtgagatcaccccaagaaaatgccagcttcataggtccctttccctgcataagggtggatacttccttccatctctgattggaagtaggcagctctttagttgtagtcatggcatctcctgccgatcacaacctgttaggcttctgctcttagcccctccaattccctcctccacacagcccccttagtggtctttctaaaatagaaatcagagcatgtcactccactgcttaaaatacctgagtggtttccgacaggcctcaggacaaagtccaaactccttgacagcttacatggccctgtgtgatcatgcccctgccccttcttcctaccaggcacccagtctctgagctgccctgaaacagttgcaggatgttcctttgatgcatgttactcttactctcatggcttaggatgatgctgttccttctgcaggaacattcctcctaagccctgactgcccccaaatccagccttttcttctggttcatttctgctttgttttccagcctctcctgagacatcacttactgcacaaggcttcttagactctcctccatccttcccagagagggtcaggtatcttctcgctgtgctctgtgccctttgctgtgtttaacatgggcctcactattgtgcataacctctttatttgtctccccctctagatggtgagctctatgtggataggaacaacatttgcctctttcactgccatgcccccagaagcaaatgcagtgtctagtacccagtaagtgttcaaaaaggtctgctgaatgattgcataagctgcaacatatgccctaccacctcttctaacaagatgtcgtgacatgacatgttagggggagtagctgggggaggaaacagcttggatctctatgtttcccttctactcctgcccttagaggcctgtggactctttgctggcgagacttgcagccctcaggtggtgtgaggaactcagcaaaaaggcttctctttgagtgtcccacctaccttcactgttccttccacttccacaaaccagcgccttaacatggcttgaatctggccatcagtcagctcagggttggcattgtggattttcttcttgaccaggtcctccagcagaagacgcctcagccgccagtagaagaaggtacgggatgttttccaatccaggatatcctacatgcagagaagaataaacttagcccagtcctaattcctgcttaatgctcagtctggagggaaacccacaggcataaaaactgattctccaggcaagcccttcacagacccaagagctggctgtaaactcctagcacttccagatgtcccccagggcagaaatgcagcccacatgccctgctgtctgcagcactgtgcacagccatgggcctggctaatgctgatcccacacatggctgagatgttctggggaagaggctgtgagttcccagataaccagacaaggataaattcgttttgagaagatggatcaaacaacttgcagatcaattattaattagctgctgcgggagccttgaccctatagtaacccacatcctgaggacccgtcaccaatgaagtcacatgtgactcagtttcccaccagtaaaatgcagcttgcctcctgaggaattaatggaaacctaaattatacattgttttaagatgataacagttacagaaacagtgaaaatctaaaaaatattgaaaatgttttgatctgcagaagttgttttaatttggccctcatagctccctgcttatgagcctgtgtgcaacacacacacacacttgcccacatgtgggcctctgacaagaagtggcaaccattgtacttacgctaataacacccttctcctgcatccggcctggtgtgtcgtgcaagtcagcaaactgcacggctacctgatggtaaatgggaattaggaattcctcccgctccttcaacttgttctccaactccttccgctcagctgtgcttagctctggggtccctgcaattagataaacatgcccgtcacactctgtaatgaccaggaatctctctgcacaaaagcagccacaatcacgggaagctcaacatcagcctgccccctcttccctctgtggcctggctctccgttgtcttctctgctctttgctgattaacagggccctacaagatgccacaccagtctttaccttgccacaagaagcccacatgccctcttttccctgtggcagtcacaagtgtgaaggcagatggcagcccctctcccatgcctctccctgagaaggtgcaagtagcgacctagaggcctgctgcatattgctgacaccacccaggctcctccttcccctgaggccagtacttgtacactgacaccatgcccatccctgctgaccagcatcaaagcagctgggctattccacacgtgggatgtggtgagagcacccctaaactccgagcacaaactagtagctcctgtttccgtgtacatgcgagttatctgccaaacttggcaaggacctgaataactcctaaagttacaagccatagtacttcatggcttctaatctcaggtttatatactcttaacctctaattagtagaactcaatctaattagagctagatcctcacatcttgtgtcagctcagtgggttagcctgtgctctcccgcctgggctgctactgccagagccagtccctgaccagacaaagacattctacttcttaggctaaaggagaaggaggatgtaaaaagagaaaggcagttggcaaacctcatttggatcactgcgcacggtaccctgactcaacagacaggagactttggaaccccttataccaaggagggacccctcccccaatcaatagtgtcccagtagaggtgttgctatggtgtgcctttcttcctaattactctcagaatgggatctgcaatcaatactgaaaatttagctgcctgcctagtaaggaggagtaagcctagctgaaggagcaataggtgacagcccctggtgttagggacaccctgaagtgctttgtcaccaaagctgacaaataaatacatgagcacaggtgataggatgcagaagaggaaggtctatttcaagcatgcctgtctgggaacaggccttgttttttacaccacaatgaatcatatgccataaaaacagccttgggctgctgactgagccgtattatacataaacacaggttaacagaggagggatgtaactatagtacttaagtttcatttttattagttttttggatgcccaactctacctctttttttaagctcatcaccattttaaaactgtgatgaaggtgccactgatctgctgctttaggccccggcgcctcagtagtgttccttccaaaacacctgaacagcatgaacgcaccgggccccacactaagggatgacacaaaggcccattgcattctagtgtagatctgcctggagggctgatggcgggagggctgagggatggagggctgatgggaggagggctgatgggaggagggctgatagcaggagggctgatgggaggagggctgatggcgggagggctgatggcaggagggctgatggcgggagggctgatggcaggagggctgatggcgggagggctgatggcaggagggctgatggagggagggctgatgggaggagggctgatggagggagggctgatggcaagagggctgatgggaggagggctgagggatggagggctggctggtgtcttcggagatgagacattctcagaacacccttgttagggaagcaaatattttcccttctccacagaaagaaaccaagattccctggagaaatagctgattctagggatgaggtagggaaaacatcagatgaacctggggtatattgtgacaaaaaaacaaggaagccctcaaaaaacgattgagacatgttagaaaaatgcaggagccagttttgaatgtgttcccactgcccaattctgggacaatgaacactaaaataaataatgatatttattaacagacagaatatttgtggaatgaaactagaatctaccaattcaccctcatataagtaattaaatgagggagaagggaaagggaacactctctcttccagcagaagaacaataagtgtagcggaaatgatggaattagaaaaatcaccgttttacaagcatcactgtaaattactcttccaagaatcatcaatggatgtcaaagccagtgggtgaaagtttgataagaaacagaatattcacaaggtcttaaaatattccttacaaatcacttattaattacaaaggggaaaatggtaactttatcgtggattaacctagtgaacaacaccttaagcaagtaattaaattatcaccaagaggacagactgataccatgactcctgatgatgtactgagaaggacagaacatgacttccgcaacattcctgcccaaaaagcagaatcgaaatctaaccacaaacccaaactgaggaaacatgctacaaaaaaagtggctcactcttcaaaaatgtgaaaaacatgaaaaacaaaggtcaaagaatcagtccagattaaaagagaccaaaaatacttgacaatgaatttcaatgtatgctcattagatcagatctcagaccgcccctcaaaaaaaaaaaaaaaaactaaaaaggacattgagacaattggtaaaattttaatatgaatcatggattagacagtagtatcaatgtttacagttcttgattttgataaatgtattgtggttatgtaggagaaagtctgtgttcttagaaatacacactaatatttatgaataaagaagcattagggccaggcggggtggctcacacctgtaatcccagcactttgggaggctgaggtaggtgggttacttgaggccaggagtttgagaccagcctggccaacatggcaagaccttgtctctactaaaaatacaaaaattagccaggcatggtggcacatgcttgccatcccagctactcaggaggctgaggcgtgagaattgcttgaacccgggaactggagtttgcagtgagttaagatggcgccactgcactccagcctgagtgactgtctcagaaaaaaaaaaaaaaaaaaaggcaagaggtccacagattactttcaaatggctcaaagaaaatgcatatgtgtgtggagcaagagagaataaatacatgtacacatgtgaatatgcagaaataataaagcattgggatattaacaataggtgaatttgagaaaaaagcattgtattattcttgtaacttttttgtgaaattggaaagttttaaaaattaggcaagctggaaaagaaaacttattcctggctatccaatgcatacaatcaataatcaaagctaatatttatagggtactgggcaccattctaagtgctttatatctattaatttattatcacaacaaccttaggagtctggtattcttattattcccattttacaggtgaggagactgaggcactgagaatttatggacttaccaaggtcacaaagctagcaagtgacagagccaagactcaaatgcagcagtttgggtcccaaagcttttgaacactgttagctgtctcttctcgcttacttgggcagaagacacgtgcttcagtagtagtgtccctttaatttctgagaggctaagtgatgatggtgggctcctggctgataaaggttctatcttagtcccaattccataactaagaccaggacaatgtctccaatagttcccattcagatgcaatttcctaggcaggcctaagatttaagagttgtgtctcttgttactgtgagttcaagaactaatacaataataggtaaagtcacagccctgcagggagcaaagggatggcaagaccactgacatggctaaacgcacatatacatggaccatatctaacacaccatttattgagcatttaccactcactgcactcaaatctttcaggatcacatatcataatcaccaagcacaatacagatctacacacctacatctggtcagctgttaacactgctgccaagctgaatacttcaacgttactgcgtgctttcccagttgcttcaggtacatgatctccaatccttaggacaactcaactttatgccagggtgtctattttacaggtaagaaaaccacagctctgaaatgtaaagggacttccccaatggcatccagctctttttttttttttttttttttttgagacggagtcttgctctgtcgcccaggctggagtgcagtggcacgatctcggctcactgcaacctctgccccctgagttcaagcaattcttctgcctcagactcccaagtagctgggattacaggtgcccgtcaccaagcctgactgatttttgaatttttcatagagatttggttttaccatgttggccagactggtctcaaactgacctcaggtgatctgcctgcctcggcctccaaaagtgctgggattacaggtgtgagccaccgcacctggctgcatccagctcttaagtggcaaagtcaggatttacacttgggtctggctctctccaaagcctgtgttcttccacattaaatggtattgaaggctggcaagcagatatcctgcagtggccactatagggaaaccagctggagagttggtttgttgttcgcaaggagttaagagcaaggctcagcactggctgcagaagagggagcagctacgggctgaggacagtgtttcagaaaccaggctttggcttcgccaagttggaaggacggaggatgctggcttctgggctaacaaaggtcttgccctctcaatcaagctattctagagctttgaaagaataacaaaataaatgcctgtaatgctctggccctcctgagactaggaagattgcagggcattcctccaaagcctaccttgtttgattccttcagtaatgcctctgattatggttcaagacccacctcaaaaaagcatcaaaacaaggaaaagactgaagtggagaatatatgtgtttttaaatgcccatgtgaaggtcaaggatttgtgtgctttgttttaggggaaaaaagatttttaaaattttattttctaaaaataaaaggctgctattaagccagttatatcatgtgttgcacaccgagggcccctctctccttgtacagcaaagcagccagccccggtaatgatttaggggagattaacaaatatgtcaatgtctattttctgcttaatttaaaagtggcgtctataaagatttttgacttctgaaccctgttctcctgaaagaaagaaggtaagaatgaggagggggataaagagtgattatcctatcattgatcgtttgtcaggagcatttcttattcactggactattgtaaaaagctaagctctcgatcaatgctgtaagctccctgtacaattaaatatcttgaaatggttttctttcttttctagccagattgcagggcctcagggattttaggaaagcaagttggtgtgtacacgtgtgtgagtgtgtttaagaatatgctacagagagaaaagtcattcttttctagaattctacattaggaaatggctgagtgggagtaaaaaggtaggtgctcccatcctttcctatccaaaataaaaagtccctatgcaagttgggaggactgcctgaagccaggatttcaagatcagcctggacaacaaagcaagaccctgtctctacaaacacacaaacacacacacacacacacacacacacacaaaatgccaagtgtggtagctcacacctgtaatctcagaactttgggaagccaaggtgggaggatggcttgagcccaggggttcaataccagcctgggcaacagagcgagaccctgtctttcctcctgcatgccccccaaaattagccaggcatggtgaagcgtgcctgtagtcccagagatactctggtggctgaggcaggaggatcgctggagcccaggagttcaagctgcggtgaactatgattgtgctgctgcactccagcctaggtcaggagtgtccaatcttttggcttccttgggccacattggaagaagaagaattatcttgggccacacataaaatacactaacgatagccaatgagctggaaaagaaattgtaaaaaaaatctcgtaatgttttaagaaagtttacaaatttgtgttgggccacatgtggcctgcaggccacggttggacaagtttggcttaggtgaaagagggtgaccttgtctcttaaaaaataagtccccatgaaatcctaaaaatgcacacttttaattaaaaaatttaaagagttaaacagagacgaaatatcactggtcaaataagaagagctaacactattgagatgttactgtgtgctggtactgttaaagtactttttatctcatttaatccttacaacaatcctaaaagatgaggaaactgaggcacaaaaaagtaactcacccaaggccacaaagctaggcaacagtggagttgtgattttggactaggtaatctggtttaagagcccatgctccttaaacaaagcagttcaaattgacttgaaagtatccgcagcacagtggcctatcaggtgttccctggagccaggatacaaagaaaagccacatttctcctccatggtatcaaaggtgaagagaggctggacacggtgggtcatgcctgtaatatcagcactttgagaggccaaggtgggaaggactgcggaggccaggagtttgagaccagcccaggcaacacagggaaattctgtctctacaaatattttaaaattagcggaatgtggtggcgcatgccttgtagtcctagctacttgggactgaggtgggagaattgcttgagcctgacaggtcgaggtgtggtgagctgtgatcatgacactgcactccaggctggcagacagagtgagaatctgtctctgaccgaaaaaaaaaaaaaaaaaaaaaagctaaagagaaactcccagaggaaacggctgatttctgcagcaggaggcaattttttgcccagccatatcacttaaataggccaggagaaggtcagccctagtctgtgtatgaacaaactacatcctaaaagtaggatttgggggaggtgacatcttcaaagcttggaataaaaatcagactggtagactaaaaattctctgctcagccaaaggctctaggcgaccttgtagaaatctttttccttttctgagttgagttcctcatttatgtaacaacaatcccagtctggcaaacagggaaaatgttttataaaagaatgtgatattaaagtgtttttaaaaacattctcaacttttaaaaaagttatacttggtggcaggcacctgtaatctcagctacttgggaggctgaggcaggagaatcgcttgaactcgggaggcagaggttgcagtgagccaaaatcacgccactgcactccagcccaggcgacagtgcgaggctccatctcaaaaacaaaaacaaaaccaaaacagttatactaagaagcctatgtaaatttaaatccaattttaactttgatgggcccttcttcctttacttaagaaagcaatttgcgccaggcacggtggctcatgcctgtaatcccaacactttaggaggccgaggcgggcggatcacctgaggtcgggagttcaagaccatcctggccaacataaagaaaccccatctctgctaaaaatacaaaattagtcgggcatggtggtgcatgcctataatcctagctactcaggaggctgaggtaggagaactgcttgaacccgggaggcagaggttgcagtgagccgtgatcgtgccattgcactccagcctgggcaacaagagcgaaactctgtctcaaaaaaaaaaaaaaaagaaagaaagaaagaaagcaatttgctttgaatggttcaatacttatgatgctagagataagaacaagaccaccctccccagaaagctcctgaatatctcagatgttaaaacatactcccatccctcaaccttgagactgaaaaatcagcataaaaaagactggaatcttattaagattcagaagtacaaacacaagcagttgtttaaaagatctatgtaatcacattttctatgttgaaagaaatttttctataaacatagtaagataggtaaaaaaaaaaaatcctgcaaaactatttctatatccataacaggtgtgcctttctttacacaaaagcattcttgaaaaactgcgtaaatcagatcctgttttaaatgccttaagggagctattttatgaggaaccctgcagtgaatcctttggtaaggcaaataatccttttgtaatgggaataatttctcccaatgtatctagctttttttaaaaccccattttcatatatctgcttttcttcaaagggggccatacctatctaaatacactcacatttgcatattgattttaacagcaatcctctcaggggatgtttaaccctaaagttccctgcaacagtgttagtgctctactgttcatatttttaaaaatcattatattaatagaaaacccagagatttccaaacaggaataaaaaaaaatactgctcccccatcagtcccgtccctgtgtttccacgcagacatatccatataaaaaaggtcagggaacagcacagaattctctgaattcttctggtagaaatatgcctctgtagtcttcattattttccttccctaatttgctctccctatgtctggcaggtcaggatacggggatctggtcatttgggaccaagacacattctgatgacagctttctcttgggttccctctaactaaatgcctgccaggtccctctggccatacagaattgtgaaacactgcttccttgggggaggcaagcccaggtgcttttataaatacaatcagattaaaggatcaaactaaaatgacccctttctcttctcagaaaattttgtcactattgcactaaacttcaccgagccaaatagcttctgaatcagtgtgaggggtaggttttcagctactgctaacaaaagagaggaggcaagatcccatatctaccttcgtgatagaaagcctcgtgttatttctcatcagcctccttaccgcaaaggacacagtggccatagtgtcagtgaggacactccaagttcaacaggtgagaggtgaaagaccactcactaaggcatgcgtatcggaacttctttctttcctagtcttaactttccaggcaaagacatactttctgcctcaaacaagcaactctggctcttttcagctttcagcctctcgaagatggacataagagttggaaaaacacagctcagatactttgatcacctctgccagaaaagcagcttaacccttaagtccccttagcccagggaacagtccttttcctgtcattctggctgctagagaaggcttgggaggaaggcattcctgaagatttttacagagaagcgtatcctcacctgccaccacaatgctccatatctgcacctggggcaaccttgaccctgaaggcatggtgggtgtgggcaggcctagaaggaccaggcaagggccagcagcagtgctcactcagtccatgctgctgctccctgtggcaggcagtcagggcatgttctgtgtgggcgcagtgcggtgctgcatggcaggctgcccagctgcctgggaacagggccacaactaagaacaagttcccctaagcggctcctttgcccaggtgctcttcattttgagagagagggacagtggggaacttacaattgcttcacacttgggctggacagttctctctccatctaaattgatttgtcatttctctctgaacacaagaggaggggaaggatccaggagaggacctcaggtcacagcactcaagaggccaggctagcaaggccgtcccgctccacagccactctccctgctcctggccttgtgaggcagtagaaggatgtcagagagagacaaaaaggacttggagggctgcggctccatttccagagaagaaatttaatttccttaaggcaaccaaatggtaggaagtaattctcctccttgcaatgactctaccaagccctggttctgtgaatcagggtcagaactgattcagcaatgcaagactctggggcctgggctttgctcacttttctttctgaggtaattcttccctttacttctattaggaatcagtgtaggcactatttacatattttctgttataatcacagacctgcaaactagtaattcaccatctttccacccaaactaaccatgtaagatgacaaaaggccatttaaaaaaataaaaattctagaagagatgaagttagctgctcagaagtcaaatattactcattcttataaaatacatagcaattatgattttttttttttttaaagacagggatttgctcttcttgcccaggctggagtgcaatggcgcgatctcggctcactgcaacctccacctcccaggttcaagcgattctcctgcctcagcctcctgagtagctgggactacaggcatgcaccaccatgcccggctaattttgtatttttagtagagacggggtttctccatgttggtcaggctggtcttgaactcccaacctcaggtgatctgcctgcctcctcctcctaaagtgctgggattacaggcgtgagccaccgtgcccggagtaattatgtttttgaacacagtcaatcagttgtgcgctggtttgtctaagtgatctgtgagcacgctccccagtaaagaggcagatttggggagagaacggcaacacaagataacatccactcctacaggctttctcctaaatcagattttctctgtggaaatggctttagattacaaaaggaaagaatccttgtttaatttagttcgggctcagtattcagttgaggaaaaatctgaagaaatcctgagaaaaggagaacacagagaatgagaattccattctggactctgatgtacatttatttattttgtatcttagatgattcacttttttggcctcaatttcccagtctgaaaaatgagaccattttcacccactttgtgaaaaagaattttggtagtttggttctaggcaaactaaaagagccagaatcattgtgaaccccaaaggaactgggttcataatatgtcctgttatatctaggctgacctgctttgtcgcagagacagctgcccgtataggatatccctgagagacaggactatacttctgtttctttcatattttcacatgtgggactgagccacagagaatactggataccaaacatggccatctgctttttctaatgattaagacagaaagataatgatgcaatgaagtaaatgcatgctcatctgctcctcatattagctaggcagaggtgtgatctccactttatggttggaaaaaaactgatgttcggagaagttaaataatttacaagactcgtagttcgttattcttattccaagtccactgctcatgttcccaagctgccctaggccagagcctgcttcacatttagcagactaagggtcctttttcaagtgccattttggtcaaggttaaataaatatggttttctccaatgcggataggaaattgataatgagatgatttgtaacaaatgattaaacggctatcacttgggagtctcctccctctccccttcatgtgcttcaaaagttaaaaggtgctggttgaaggtgggagcgacatcactttccttgaagagaaagaagctttatctccacacccctcaccatccagtccttctgcaaaaggagaaaggatccctctccctaccacccagttactctgaagggatgataacagccattggggggttaaaaagaggcagtgaacccccagttaatgagtaggaattcagcaggcagtgtaagataaatggagctctctctgcttctgctagagtcagcatgaactgcggccctgcggcttgtttgtggcaaatggagtgcgcgaaatatcaaagggcagtgatccagaagaagaccgactttgacaaattttaaattggccagaaagaaaaccagcaaaaagaaaaaaaaaagggaaaagaaaaaggaagaaaaaaaggaaaaaggaaaatgatgcaatttgctgtgtcctgcaattgcggcattgctgcctttgtatggaattagtggtaaacacagcggcaacaattgggggatgctgggagcaattatgagccatctaagtgagatgcttatcagtggctgaagcttttagagctctctctatgaacagttgtaagtaacttgctcttgagctgcagttactttaattaaagtgtacagggttggtcagaagtaattattctgtttggaaaagaaagagaaaaaacccacctcaattctgggtggcaatagattttagaaacaactctcatttcttgtatgtgtgcattccccataaaaggatcagactgtggtgagttagagttattggtggctgttacccagtggcaaacaatgggacacaaacagggtttcttgtaacccaagtcaccgtgtttggcaggcaacctggctcagggctccaaatgcctggatgtacagtctccacagtgtaggcaaacgggatttttctgtctctggatggtggggatatacagtccacaaatggtactttattaattaaattaccacttggaacataaatgagctagcatctctcttctccattcactgagtttcactaccttttaaaggcaatctctgttcctttagaaaaaaacaaaaacaagacaaaccaactgacaaaagaacctcgagcaattatctttactaacatagcaaggggctcaatgggagacctgggcagaaaatcagtgttttaaaagaatctgaaactcatttagactctggactcaacacaggactcccatggtttagtcctatgttcaaattgccaagtggcttccaaaagctctgaaaacaaatgagcaacagagcaatggctggaagcattaagcacgcctgctctcagggctattctggctgcagctactgtttggaagcacacagtgcgcaatctttacttctatttctctagctcaggaagaccccggaacaccacctgggtaaagactcctgcttttctatcccatctctcagaaatgaagtgagctgtccaaagaaacaagcagaaacaggacatatttaaatctagcatattctctggtgaggcctgcccccagcagcaactctagctaatcattctctacaaggacatcttagaaagacgggctttttgtactctaaggaaatatcaggaaaaaaaatcaggtgacttttgcttttttagggctcactttccctattatacacactatttcattctaccagggttcttaccatatagaggacagtaaataaagattatcatgaatttgatcaaatgcttcagtgcctcctcccctggcctatgaatgcactcattacaaatcagctgaatggctcattgatttgccagaaggacaagcagacatacccaatcgctcagccaagtggatgtagactgggtccacccgacgcatggttttcaccagatcctttctgcggaatttgatttctactgtcccttctggctccagaacagatcccctggatcagaaagaaagaaaaaacaaaacagaaatagaggcactttaaaggaaggagacaacagaatgaggccagttacaatttgtagaccaggaaatagcttcattatcattttgcccacctatggttaacagacatctccccggggagaacagtaggcaccagagaagtgtctaagtgaggtatgagaaaggcctggcaaaaagcaattaaaataattctcattaccacaccagtcgacttccatttcaaagggagaagaatacagattccaccacctacagctgataagagtaacaggaatcacattattttccaggggaaaaaaatgctgtaggcacagtgacaggggaaccacctccatcacgtaggatgtacaataatgaagggcaatacttcatcaatactatctatctatctatctatctatctatctatctacctcacctataccacagctgtcagtctgcttgtaggacactgatcagacacactaagccaggccaagtaggaggtaaaacattctgcccagcgctatggaaatgagcagagtcaaaggtctcagggttacttttagtgcatactaatgatgttcagtccccagaaactttaccccaaacatgtttaaaaaaaaacccacagctttctagtttaaaaaaattatagataatgtttactatgtacatggcactgttctaataacttacatataaatccttacaacaatcctatgcccagtctccatctactatgtagtaaggttctgtgattattcccattttacaggtgaggaaactacagtttagtaagttatgagactcgtccaaatataacaagaggcagaactggatttgaaaccagacagtctgattccaaagtctatagaggaattgtctctgatctgatatcagatgagtttaggacttaaaaaataataaacccctaagtacagaatgtaaataataagcctctcagcctagaggtttgacagtgaaactactggactctcctaagcagcctttgacatagaaggctgaatctggggggacaagagagaagcgggcggtccactaaaacgactggaggtaagaatttccttggaaaatgtcaaagaaacacgttttgaagtttacttaggaaagaggtgagaacagactatgaaaggatgccagattagatctgttttatttaggtagtttcaggtaccacctcccaataagcctgaggttctcccttacagtttttttgggtgctacaaacaccatggtcttcagcttcctgaaatgctagagtgaggacctggactgtaatggaaggaaaaagctttggtttggaatcacaggatgtgggtgctgtagtgccatggctgtaacattctccaggaggaaaccaacagctacagggtccctaaaggcagtgaatggaaatgtggaaggcacgctacctgctttctcggtcagcatacatctccatgtgccgggggttgatggaggagtcaatcaccacccaggagccaccccgcagctcagcctggggaggaatgtaaaccagcacaggctggcagcactccctcaagccatccacaatgtaagcaccaaacttcagcacttggtcgtacatatctatggagaatgagacaaattagaaatcaagaaatttctcttcctcaaagcagtacttttaaacactgttcaggacctctggccacgaagagcctccttatactatgcctcctgtttggccaccctatagactaaagggagtatcgacctgtatcccattcaagactccagaggatcttcaaaagcacaagacagcaacagagagatgcactgtctttcacaagatacagtgtgtaagtcttccagattgcctttccattttatatcctctctgaatttctgtactcacgtttcaccacattaattcacatttgctctacaaacgttgagtatttttcatgtcaatatgtgctctcccactacagtaagtttactaaaggaaggaactattctacctcttttcagttattctcatgatgcttagcataggatgagctcttcaaatgtgcacctaatggaaattgatcctttaaaaattttatcttcaaaaactatttttcatcttggtatcccgatatccctgcccagtgcctgaacatagttagtgctcaacaaatatctgctgaatgaatgaatgctgaataaattagttatatactctggaaagaatataatgagaaagaaagacaaattctttaacagttgcatttttatagggtatcaatgagagaaaaattttaaaaatacttaggaaataccacacagccacatgagaagaacagacccaaccagggcagcatagtgagaacctgtctctacaaataataaaaaattagctgggcatggtggtgcatgcctgcagtcccagtcacttggctgaggtgggaggatcacttgagcccaagaggtcgaggctgcagtgagccatgatcttgccactgcactctagcctgggtgacagaacaagaccctgtctcaaaaacaacataaaacaaaataaacaaaaaacaagagaggaaccacctcttcattctgctaaagactacactttgtagactgggaatggtagctcacacctataatcacagctccttgggaggctgaggtgggaggaccgcttgagcccaggagttcaagaccaacagagagagaccctatctctacaaaaaccaaaaaaattagcaaaacatggtggcacattcccatagtcccagcaacccaggagggtgaggtgggaggatctgagcctaggaggctgagacctgcagtgagctgtgatcatgctgctgtactccagtgtgggtaacacagcaaggccctgcctttaaaaaaaaaaaaaaaaaaaaaagagtacattttgtaatccctccaaagccaggagcagcctgaagaaaaggacccatgatgtacacataaagtgagtccctggaaaactggatcagttatttatttcccaactttttatggacttcccatttcccagctcactgaagtccattgctaaagctttaggtttatgagtccagatgtttaatgagtacttcagtggagccacaatggatcctttctaaataccaaataacaggttcaactgagatcaaactttcttatcaaagagaggatctcaatttggaataaatcaattctgggaatccaaggcaaagaagcatttttcaggaagttaagagcaaaccaaatagaaattgctttcattgtagttactggcaaattaaactgccaccttctccaaagtaaaaatggcttaatatacaaactatcagtgagcacagttcactgcaaggcacatgctccactgccccaacctggtgtgtctgtgaagacttcagaaattccaagttaccccagaaaacaccccctactctatgtggaatgtgtatgatatgtactccatgtatatgatcagagtgaagacatttattcctttgggagaaaagctaagaccaaaaaaatttactgctaattaacaactgctgtatgaagagcagggaataaaggactttaagtgctttacgctaattctgtagttatgaaaataattgctcagttcaaattattttaactaaattaattctttagtggatatttcaaccagtgctacataataaaataattgtgtaattagcagtacatttttcagtgctgccaagagtacagtctccgaacaagtaacagaaaagtgtccctcaatgatatcatacaaagagaggaaatgaaaggtatagataaaaggagaaaataaagcaataaaagacagcacaaaaagtcattctacctgaaaaagaaaaaaaaagttagaggtaagtgaagacaaagtttccagctcttttactcacttcttcttgttaaagacttagctacaacaaaatctatctctgtattataattaacagattgacatctcaaaaagaaggggagattttatttaaaatgtattttcattcatctattaaaaaaatactagatttcatagtatatgcaaacagtttcaaatgaagatgagtgtgtgtgtgtgatttttaattttatgaaatggacgtgggctcctttttgtcatcatcatggctagcttattgtgtaccagggaacatgattatatatacacacatataaatcatttaatcatcagaacattatcttatttatatatccaagttgcaggtgagtaaactgaggcttaaataagagtgagtggtggagataagactcaaatctagatcttgttggccctaatgtccacattctactacttcattcttttttttttttgaggtggggagcggggcgcgccaggttctcactctgtctcccaagctggagtgcagtggcacgacctcagctgactgcaacctctgcctcctgggttcagacgatcctcctccatcaacaccccaagtaactgagactacaggtgcgtgccaccatgcgcagctaatttttgtattttttgtagagacggggtttcaccacgttgcccagactggtctcgctgagctcaagccatccgcccacctcggccttccaaaatgttgggattacaggtgtaagcctctgtgcccagcctctactacttcattcttactgctaggagagacagcatgagactggggtactctgctttccaacatctaatatgatgagtaaaataaaaccagaaaaagagacttgaatacatgactgaatattcccaactgctgctggatttcctctgtgttcagaaatgttcaaaactatactgataacactaccagcctgtgtgaggcttggatctgactgccaaacaagtatttttcggccccaagactgtgagtaggaaaggagcatcagggtttgttaaagctgacatgtttgggactaatatattgcctccatctaacttggaacacctatagacccacagcccaaccatcaaaacacccaaaaagcaggctattaaaatataaacaaacacacaaataaactctgtaatcgacatgctcagactgaactgcagctgccccaaaccacttattttgaaaggcaggttgaaacacttggcaacaatctgacacacaattgtctgaaatcccttcgtatttaagagacagagcaaaagcacagccaatagcagcaggggaggggcgatccccaagggtttaggttagaaatcagtctacagaattttaaagctatgcacgtgctgtcaattctcaggccctgagaaacgcaactgggaatggaaaatactgataggttcctcactggagaggcgggagcttggagttttctagcatgctgggcaaagcacatctgcatgaatggtgaccacacacaacctttgcagtgtgctctcagcacctaggcaccaaccctgcctagggcttttattgttataaacatggataaaccgtggcagccatgtgtatcaaacaagggaacagggtggcagagtgtttccacagtgtcccacactcttgaaaatgaaacagatcttattggcttgggcaagattatctgttagaaactgaaggtaaacattagccatacacaagctacatatacataatgtctctccttagttcattatgatcggctgacactgtatttcaacatcctagtaatcagagactttaaaatagactttcattccagttaaagttttcaataaattttttttattgttatttataacctgtcccaggaaaaaataataagtataacatgaaaagccaactgagagtgaccctgtagcaccagcagtgaggcagcttaatatcactgggatttgcatcctatcaagctattcatgctgaggctgggaccctggtgctaatttctagtaaatttcacgcttgatgtctccctgttgtgggtcattgccggttcgtctaaataaactgcttccaaatggctcttccatctaaatattcagccagtttttataatttaattttgcattatgctgaatagccttccggccagatagagctcattgaaaaaaagcaccaataccatcttgacatgcttttatttatttatttatatctttactgctcgaattagacctcctaggccgactagtagagttttttttttttcccttcactaatgtcaattttcagcatagcaagagctgtctctaatcttttcctactcattacacacaattttggagtcattttacccacagtgcagtcggctcctggctgtgtgtttgtgtgcactgagggatggcataattgtttattttccctccctgcataatccccagccagtattgaaaccaaaactgcaaacatctccccaagggatgtgaagaatgacaagaggccctcagtttaggtccctttacatgagataatacaacaccctgacctgtatgtaaatatgaaaggcactgttcctccccctcctaccttcacagggatctctatcttccctaagtcttatttgtcttacgtgaggtgtaaaaggatgcatcagcaccaaaattaagacagaacttgccctggtctatatatcaggccaaaaactcatttcagaccaagggcagcagggagaaaggaatgggtacttattgtttaaggggtatagagtttatgttgaggatgatgaagttttgggtgtagataccagtgatagttacacaacactgtgaatgtatttagtgccactgaattgtacacttacaaataattaaagtgataaatattatgtatattttaccacaataaaaaatgaactcatttctgagctcttgaaatttcttttcacaataaccaaggacatccccaaagtagaggggaagtaggtggataataactttttcaggaaccttgacattctgttatagggatattctagtagatctagttctggttttaggctctaactgtgttacagggagctacatcacatcagccaactgtgttacaggaagtcagacagatccaccttcctttcccaactctgccattttgtagctgaatgagcttgggaaatttacttaacctaatttacataaatcttaatttatgtaaaatgttcataacaatataacctaccccttagaggtgcttgttgtgatgattatgtaagataatacatgtaaaattgttagcacaagtttctggtgaaaagagctcaatgaatcttaattgttgttgttcttactgttacagcgcggcagccaatctgggcctgagccaaaatatgtagcagaattgaagcttttcctagaagtggcacattggaaacttttgaactctgaactcccgttaggataaaatatccagggtgacactctgaagtaatgtcaggaagagtacattctcagtgggccccccacaaagagataagtaaggagtaatagcatagcattctctcccaggtctcaacaaaaatattagagccaaggaatttgggatcaagtgaaatctaatgctgaatgaacctcatatatatgaatgaggggttttcaggccccccttccctttgatatactactaccatcttcttttgaatatcctggtattttgtttatacattatggctttatcattttgctcaagacatttttcttgtctctgtgaagcaatgtattgtttctgacttattttgacttatttttgttctctgaagtggctagcatagttcctaacacacagaactcaataaaaatgtgtaggattgacttaaccgtatactctcaatttctcatggtatttccactaatttattatctcggtcaaaaaataattcaccttgataatctaaaaaatatatacaatcattaatttggatatatagtccaagtctcccccaagaaaagtataaaatgtggtagttctccagcaaatacaggcaaaggtaaacttttcaaccaaacacacacacacacacacacacacacacacacacacacacaatcaacctagtcaacattttgccaaggaggcctggccatacagggctcttcctagacgagtaaggaaaaattgtcggcaaaaatttcaaatccctcttgccacataactgaccatctggtagtttccccaggcatttcctccctcataggctgggggtgcttctgccctaagctatttttaagtgccctattgagagttcattgtttcacattttgtatgtcttaagtattttcttttctttttctttctttctttttttttttttttgagatggagtcttgctctgtcgcccaggctggagtgcagtggtgcaatctcggctcactgcaacctctgcctcctgggttcaagtgattctcctgcctcagcctcccaagtagctagggattataggcatgcaccaccccatctggctaattttgtattttttgtagagacagggtttcactatgttggacaggctggtctcaaactcctgacctcaggtgatccacccacctcggcctcccaaagtgctgggattacaggcgtgagccaccgcgcctggccatcctaagcattttctaatcactatttactccaaaagtttctactcctccctccttcccctaacctatcctactgttttttccttttttttgagacagagtcttacccttttgcccaggctaaagtgcagtggcacaatcttggctcactgcaatctctgcctcccaggttcaagtgattctcctgcctcagcctcccgggtagctgggactacaagcgcccaccaccacgccagctaagttttgtattttagcagagacaaggtttcaccatgttgaccaggatggtctcaaactcctggacctcaagtgatccacctgcctcagcctcccaaagtgctgggattacaggcgtgagccaccccgcctggccctatcctattgctttagaaccccaaattctccccaagacagatggaatttatacttagcatactctcataccctccaggtatgcagtctctggcttagcatggccatgaattatctggccatgggacagagggcttcactactgtaagaggtagtgtttcctttggctctccctgtagtgtccacagtcgctctacacatcaaggtttctccgtaaatggtgatactggctgcctaattacttagcaattcccatagcatggagtagagcctttgtaataatggtctaatatgctggagccacaggcccagggctgttgttagataataatataacatagcacaaattgccactggtactgaacagcctctggtactgaatttgttcattttcttccagtaaatgctaatttcagtatctgtcttggtcactgtagaacattaggagtaacaccaacaaagtatatgcccagaaaagagggacagagtcacaatcatatttccccagcaccatcagaatggtccagcatccatctgtgagagcgagatccacaacagtaggtcacctcaataacactagtagtagattattctgaaattctgtatggaattataaaatgtacttttttccattcaagttgcaactcaaaagatgtctcagagagggcagaatccccaaaaagcctaggctattaggacacccacagattctgctgaatctataccctccctctgccgcagagtgcccagtaatcagtgatgcccctccagcccacaggcagcccagtcacctttcattccaccagagaagcctctccagttggcaaagaccatcagaggcagcccttcccggttgaagtccttgatggcctgatatgtcttaaacgcagaatctgggaaccaaacctggccagcctgctggattatctattaggaaaagtcaaagaagacacaattaacaacacagctccagggggaaatctctccaaggtgaacaagattttacttatttaaaactgaaaactaaaaatcagatcaacaaaaactattgttcatcaagatcatcatgtttggagtaaaaaagaagaaaggatcctcgatctttgaccttgtcaaatactattctttttaagtcctgattataataactctgtagtcaaaagggaagaatgcagtcctaagaacccttgttctaggtttctcaaaagctacttaaaatggctccattgtgctactctttaaagcaagtcaattgtacatagtctcccagtcctttcacctttgtgcttagtatagcattttcctgtactgtggctaacaaatagacaattgacgtcacactgctgaatagcctcctccctggcctccctgacccctcactttctgaatggtgtcaggatgtgaaaatataatccatcctttaaaaaaataatggcaccaggcacagtggctcatcccaacactttgggaggctgaggcgggaggatcccttgagcccaggaggtcaaggctgcagtgagtcaaaatcacaccactgcactccagcctgggccatgaaccatgtctcaaaaaaaagggctgtggtgttcacgcttggcattagggcagacttcaccgttaactctagctgtagctcttccatgtgtatactcagagaataggggaccaaagagccttcagtattatctcagctacctttctgtaagaccatctccccaacaaaagtatacgttttctagcatcaagaagactactgtaaagacttatttaatttttgaggcagaatttagcttctagtccgtttagactcaccttaaaagtgagcacatgatgttctaaaatcattcaaggctgctgatgcccttccctctaaaactgatggtttgcaatgttcctgatgtattcacaggcactgcgaagagaaaaaccctccaagcacagcccccagtgtacttgaggtggcctaccttggcttcagaatccaggtttgctggatcagctgggatacttagttctactgttcgggtttctacagcaacaactcccacaggtattcctcctagcctgataaaacatgagtcacataagaacccaatgtatgtcaacattatagctagccatttgttttccaatcccaaatcaagacattggggaaaaaactagaaacaaacacagagagcaggggaaatctgattcttctatgagttaaatgtgagactctacggatttgatatttactctctaaatatggtgggaaaccaccctcagaatcacttctattcggaaatgtcccaacacaagataaattcaaaccaagggctgttctaggggagcctctacatttagactcaacagcctagcacatatacacatccctacccctgtggctgctaaacgaaatttctcagttcactctagagcatctccttggtgaagatggtaggaaatggtctgaaaggcagtaggaatctgagactttcagtaacttttaatgaggactgaccttgctgaaatggagctgtagttttctatggaatattaataatgtggttccagataagatttgagggtacaataggtcttactattaggtgtgtggatagggagtatgtaggcatgttatgaggatgatgagaaacacatgccaagaatagggaagtggatcaacaagcccttaattttctccttccttggaaaagacaaatgggacaaggataatttttagtagtaatgctggtgaagtctatattagaattatatatttaatctcaaagctatgtttatttaaaaaactgtttaggagctcaaagcctctgcaccttatactccactatgacttcccaatttggtcctcataaagattttctaggaaaaatcagagagcaagacaaagtacagggtgagtctttactctggaaaatgtgatgcagtcttcattctcactgttgcattccttggggttggggctgggatgggttatagtctctcatttctcacagcatctccataacaaacttttccatgacagatggcctttggttgttaaattggctagtgaaaatggattcctgtcatcacaagagggctgacaagggcctgagtggagaccacccacccccttgtcacttgcctgcactgaatcagaatcaaaagccctctagacaaccagacaacgagcaggagatacacaggagggtttagaaatatttctgttcacaatgattaacaatccaactggaaacttgtaattgcaaaagccaccctaaatcggtaacttataacttatatattagggcccatgtgacctaataaagaacatctttatccaagtattacagttatttattgaacttgaaaacagctcagaacaacttctgttttctattatacttcatataaattttatcaggctagcacatgaagatgctacatcttgttttatagtgtgtccctggacaaggtgccatggaataataaaagacaatttacagccaatagcacacatattccaaacatacataccaaagatgagttttggcagcacttacagtaacaatcccagacgaatacatttatatttatttcttgaaatgccattgcttttgaaagaagctagagctccatttgtgttttatatacttgtgagtatgtgtatacgtttggagtaagaagcccagaactcgtcagatagaaagaaaggaggaagtcagagtgagtgttgcaataaacaatgacagagctaaccaaagccaagcttgactgatcttggtcgcaaagcaatccctattcttctaatcataagtgtaaagtatttttctcttatttcccatgggaggatcttaaagaacttaacaaaggtttggctttctgagacttaaaatctgtcatgttttttcacagacaggaaaattgaagcagaatagatgagacaaatctcaaaaaagttggtcttagtgtgccgtgaggaatctaacaagctgatacaggagtcgagtatcagggttctcgctccagtgtatctcctacttccaagctccccactgggaattttaccaggcacagagaatacttctcactgggactgagaagcctggggtgagataaaagacctgagactttaaagaaaacagacaggtaggctctgggacattcagtctgagctgactccaggccagaatcctattcagagtcacagaggaagaccctgtctgtgggatttgccctctgatggcttcttgtcacaggcagcatggaggcgtgctgacctgctgtactgagagaaccacagagcctagaattattttcaaggctagaatctaaatctcaacccaatgtggcatgtttgagaatcttgagcaggtgccacttttcaccaagataaggaaaactgattgcccccagaggaaggtgagctccagatgcggtccctcagcagcatgtctctgcagtgcagaagtagattaagatcagtcgtggcaggtgctcgttatagctcgttatagcaagcactacagattattttgcacagagcttgctgttgagtgaagcacttcttagagtaggtattaaaatttaatagaaacttcaatttcccacttcaaaaatataggtatcttggcaacctatttcagcttattttactcctgtttcaggtaaacttttttttttggcaattcacatctgattataatccaatatagtacatttgtcacttaaataatctcggtgccacgaagaacctctttccagttacatagaaaagcagatgagtctctgaatcacttgtcacctattcctgaaagaaaattgtctttgggagagggaaagtcattggtgggctctggctattgtagttgggctttacagctcccaaagtgtttttcctgaaacattataaaaaggaagtgttgtcaaaattagccttcagattaaacgcatcattggagtgacacacaaaatggcaactgagaaccagcactccaattattttgccttgggcatggctataatccaatattctcagacagttcagacaaagagaacattattggtatatatctatagagccatggctctttctttcttatttttagttgggaggaaaaagagctgccaaaacaaaagagctcttacctggctctaccaaccaccacagtctgtgcccagggctgcataatctctgagaaagatccatagtcaaaaaagccactcaaccactgacctttttgggctacagaagggaaagaaagaaaacagagaataaggacagtgaatccattgacaatgtgctggaactgacgaatttaaggtggtttgggggattattttggggagtttgttgtttttaaccaaattataatagatggaagcattaggcagctgaatgttcatctgccttcagacatcatctcctatttcatttgctagtctgcataaaaagaatcatttatcagcaaaagcatcatttattgttaaatgacaaggtttagctagcagagagagtttgcatgcttttaaataaataacttgactttcttcaagacactacaaacatttgtcaaaaggctgccaagtcattaaagatattttcaaaatgtctatttctattttaaaacttgccttacaattttgtttgattccactgactttcttttaactgaaggctaaaaacaaccaaacaataagtattaatgatcagataaggatccaaatttggagggaaaaataggaactcagtttctccgctacaaaagcaacaagatatatctactttattaaacagctgataaagtataacctttctacaaaaaagggccacatattcttgacagatagtaaaaatacaatggttaagatgcacatacttaatgccattaatcttccttgcacatagaatttccttcactggcaagacccaaaattttcaacatgttagtttaaaaaaaaaacttttgttccacaggtataaatgtttgaccaaagccccataaaagcttctgcaaataaccgtttcctagtttgccctctcagctcacggttttcagtgattcttctaatttgaacatggccctccaccccctaaaaacccaagtccaaaaccaattaaaagtggagatctgagcaagctaacctctgctgacttaaacaggatggagagtgttttatctagactaaacttgtaattactgtgttctacattccttgcctctatggccccagtgtaaaatgtgatcatccatttcaaaattatctctccatccgtgagcccaaagccgatcgtttagattctggtcttgtgttgggcgtcagtttgaagaatatcacagcactatctcctctaataaatgactttaacttttcacctagaagatatctgctttaacttatcacagggaatcatctgctttctttaacgcttccactaaattaaaatctgaagtcactcgatttgggagcgagtgttagctgcacatagacagcaggatgaattactagggagtcaatgaaaaaatattatccaaaaaacagaaaacttagtttatcaaaaatttcattttattctgtggatttcattaataatggccaggataatgcccacctacacacacatacttctgttcacccatgaaagaaggactcaaattttggtgaagtttctaaaccaaatttctaggttcatcagaacactgaattttaactttatatctttggatcattttctaattcttacttcaataacagggatttggaactacagaattaacttcaagatggaaatgttttcttctttaaaaactctcctgctaggggtaggaggagtcactgactattgtagttgtgcttcacagtccccagagagtagatcctacccagttccgatgcagaaccttagaagccggctaagatggcttcccgtatttcccaggaaaaaactcactaagtcttgttccaaattctagaagtaaagaggctcacttcattcccagaaaagtcctgcattttaagactgacaggtggccgggcgcggtggctcacgcctataatcccagcactttgagatcacaaggtcaagagataaagaccatcctggccaacatggtgaaaccccgtctctactaaaattacaaaaattagctgggtgtggtggcatgcacctttagtcccagctgcttaggaggctgaagcaggagaaccacttgaacctgggaggcggaggttgcagtgagccgagatcgcgccactgcactccagcctggcgacagagtgagactccgcctcaaaaaaaaaaaaaagaaaaagaaaaaaaaaaagactgacaggtaatcttaggctcatagttcttatcataatcatggcacaaaaaaaaggggaaagaaggggtaagtggaggcggaggttgcagtgagccgagatcatgccattgtactccagcctggaggacaagagtgaaactccatctaaaaaaaaaaaaaaaaaaaaaaaaaaaaaaaaaaaacagtaggaagaagattagtatggtgactttccaggcatgtaaagaaaaactatttcgttttattaaaattaacaagaagaggcactgaagacaacaggtaaagttataaattaaaataaacacttctctcatgtttttatataatagaaagtctaatgtaaatattgtagaaaaacaatgtaatagctatataatagctatgtgaccttgtacgaatcactcaacttctctgatttttgtaaaatagttatctctctttatctaagagaggtcgtaagtgcaaaaaagatgtggaagtgctttacagtcccacctggcttacagtgggtacccacaaaagtttattaggtcttccttatgaagacctctctttcagcaagatcacaatgacttttacacttaataaaataccttctgcaatctcttctacttttatatatagcctttctttgaaatagttgcaataaatatgcaaaaaagaacaaatgcttcctcacatagtttgaaaaaatggattcaaaatacagcagagggatttggtgctccacaaaagaacctcctgataagtaaggtttgctagaacagccaaatggactgacaaatgagaatgtacacagagttacttctttttcctgttttgtttctaagttaggtaaaagacaaagcagtagattagatatatctggagggagagcttattctcactccatgtatctatataattaaaagttctggacaatctcttcatgaataaatgaacttacaaagtagccttctattacttactaaagcaagtaccaataccattaccaatatcataagaagggcacatgcagcgtgggtgctcagagcttgctgagaagagtgaagtcatattctacactgaagggtctcaaagacgtgtgctaaaacgaaactgattaatctcttttggttgtagggattagatgactgaagattctagtcctataattttatgattttatggcttatattgaactgtgttaaagtctttgaacccattaagtaataagtgctttaataacagaataaacagaagaaatgtattcgtgactgcactgcttgacttaatgggtgattgggaaatgtcattttatttatttttcattttttcatgaaggatttcccacctttttcttcagagggctggttttcaggtctttctcatttctaggtacttacctctgttttcttagtcacatgtgattgttcaggaattggatagtgattgaaaagaacgctaaaagcttaagagccaggtaccatggggtcctcaaacatatacatacttgggtgaggacggcctgctagcatccatcgaggatcgtatggggtctttgtgggaacaaactcgatgattctgtctataggatcctttgagttcagaagaggaactgaactgtgcacgctctaaaaggagattggaagagagcacagcaatcagtgaacgacagccctagactccaactcagcaacaatagttacagacaaagacagcagggcccacgtatggaattgcacccaatagtcccaatcttcagctggaagaatcctacgtatgtgccaggccccaaggaacatgtataggtcaatagtctcatttaggaggctggcacaaagtggtgtgttttgactcttgatttcagtgtgcccatgctttctgggatgctcctctgaggaatgaatggctattacagaggagaaaacccacaatgaggaggaaccttaatatactgggatctgagccttaggtaggccatgagggcttccgtggctggaagacattagaaaggggcccaacaaatgaaatccagagacatcttaaaggtagaaggcaaaatatggctgtaaggaaaagagaaatcaatagctttcagagaaatattttataaaaaaattcctccaccataaagacaagaccttaaacacagaggcagtgagctgtggtggaaatgacaggctctgcaggccatgtcagtgctgggtaggaagggctcaccttgggcatgtaagacagccagtgcaggacagtgaaaaccccttcaaagtcatcacacacagtgcagtgggtcaccccattgttgtgcataatctggatgccccccagctggttattggaggtgtacacttcccgcccgaggacctagagaaaagagcaagagaaaagacatttgtctctatagaaataaaggcatggtcgatttcacaagtcgcactaaaatgggttcttttctccacaaaacagagatttcagtctccatgggttggttgttctgagggactatctgaatcttcttcctaaaaagaaaacttagaaaacaaaaaatatgagattgacgcgctgccagctgcgctaagagggcttactatagcattaggagatatacctaatgctaaatgacgagttaatgggtgcagcacaccaacgcggcacatgtatacatatgtaacaaacctgcacgttgtgcacatgtaccctaaaacttgaagtataataaaaataaaataaaaaattaaaaaaaaacaaaaaatacttttaacaatcacattcatggttgcaattttaaaaccagcaagcccctttctctccaccagctgccacagataggcaaagcatacttccaccctcagctgaaactgcagtggtgggtgaggctgagacccagaggcataggctacctcattgtgtgcaagtctctttgcacacagacacaaaaaggtaacatgcctgtctttcaacaatatttagtgacaagtctcagttaaagaaactctgggggcttaggttcctcatttttaaaaaggattatttttttccttatatttgatttttattagattggtgcaaaagtaattgtggtttttgtcatttaatggcaaaaccacaattacttttgcaccagcctaacactggcctccacgcacaagccctaaagctagcaaaaacctgaagcaactcatgatacatacatgaacccctgagtctcaagtcttctttgtgtgctgggtgcagggctgtgatttatacccaagcatgcttcccctcctccttcccttcccaggctccagggagttcagggcctcaatccctggtatatccctggaggaatttaatccttgtaaggtcaaagggcacctgcaattggaaaccacaaagtttcctttaaagaagaaaaaaagaggaagaaaagatattcctggacttggaaattgcagggtttctttttcccttgaagactggttaataatttctttcagggaaggaggttttctgacccagcagatggaagccgggcagcctgatcactgactattgcaaactgctgagtgtatagtaattgtcagtcatctaaggtagccccggagagctctaaacagttgtagagcgcttactgtattttaccttttctttttcctttcccctcctcctttaaaaaataacgacaatacaaaatttcttccgtacgtgtattcattttcagtctctggggagaatctaactaactaagggccagcaaagtctgcctgtatattcccattttgccccttcttgttaggagctttgagaggttcccctgcatgctgggtcagcacccccatcgggaccttccaaagatggaggaagttggtgaccaaagtaataacctcagtgtgacccaattggccttgattccatttaacttcagctaggaagggcataagatacttttctgaaaggaatatggaaagcaaaattgctctcagattactgttttccttgataaggaagcgcagagaacaagcctttacaggcagccccaagctgagcaacatgctggcagctcctttgaaggagcctcgtgaagagggaagacggtatctgaccactgagctcccatccgcctctcagtccgtctttaatctcagcccaggcactgcggctcttttctcattctcctgctgtctctttccatttgccctctctctgactgatacactgatctctcggtcactcagctttctgctctgctgagtccatattactaataacacctccgccacggccagtttacctcatgaaggcaggagcacatcattacaaaataaactcataactttgacattctagcaaatacacgccgtttgttatttttatggctttagtctttctaacaggcagagggcattacatacctgtttcatttatatctttaaatgtgcacacacatgcacactcacacatgcatcaggaaacaaaacagaacaaaaaatccaaaccaaagcaaatatccaaagcagtctgttgatgcgggagcctggtagaggcagaaaccctgtcacttacagaggccacgctctgatctggctctggttttatggtcgtcataaacccgatggcccacaactggtccttctgggacagactgcctctctgttagaaggcattcagtgtgatcagcagtatttttaattattaaaataaaattggaaagggggaaaaggaatacaaaaggagacactgtgctgaccctgaaaatctgatattcacaatctaggtcaggagccaagtactccttgttgcccagaagagagagctgggccattttctactcagaaacactattttcttcctatctctaatacctgataatgtccaaccacttagaatcttacacatctccaaaactaataatggaccaataaagaactacactcagaaaaagggaccgctcagctgtttaaacatactttcttctgatgtctttgcctcctcatttaaaagtgatcctctgccacttatctattctaccccatatttttacaaaataatgggaggcaaacttggtaggctcaataactgagtactcttctctttacaagctaaaactcgggttctgatgctttggcattgttctgaaaaggcagcagtatttctacatctctcctttcctatgtttagaagaaacctaaccagggcttaacataccaagaacattatttctgagctaaagaagtgtttgtcatgtgagaaaattcacttaattcagaaattaaggagaaaaattacagaatagactaagagtatcccaatatcactctctgaccagccttatcttgggagatggggggtagggtggggatgggcacagaaatgaaactgctccactaatcacaaacaaatgctaacaatcataactacttaacaatcggtgaagagaaagcagtaccctccagttcatcttcaatgaccacatgtttggagtatgcgccagtagaatgagggcgcacacaatagctcctgatttataggggtcgttgctgactcaagtggttttaatgattttagaatacttcacaacaaaagctccaaccaaggaagcagaatctgggttaggataaaatccattctgcctaactgtgaaatgatcatgctataacagttacacaaaccctcatcagtatctaggaagacgaatggagtccacatagacagaaccattgttttcttcctcaaggttgccctgctgaccttctacagaaaaacctggggtcaacaactctcatcaacatattttcatgaagtaggtgagctgcattcaacactcttttaaactttgacctacgcatttcttgccgtgtttcagttcccaaatatattcctcttacattctacttactgtatgatacaaacttttaatttatctgtccagcaagcatcaataatcatttaaacacaggagtgagtcaaacagaggtgattctcctgaggcctcactttcttgccctccagatctaagtggagaagcagtaccatgcaatattaggaatgggctccaccttggggtcctctgctgaagagtgccatgctgacagaattgaataagggctgaatctgagaggaaagaggatcttgactcattctcaatataaacttaagcctcatccagtacttcattcattgcagccggcggacctaagaattaagggcaccacataaaagccggtgattagcagagacacaattgttaaaggctccaccaaagatgctacgtagcctttagaaatgttgagatacataagaagtacaaatgaatgcagtcatacgtccatgctcaggcctctgctgctgctgctgcttatctagagacactgcagacagctcaggtttaccacagctgacaggcaatgaaaacagcctaatataccgcctgctctctcccttaaagccctttttggagatcaagataaacacgtacttcctttcccccatgctccagacgtttgactgaagtggcagagcattgtgatgttttgtgcaaatgaaatcactatgtaatactgaatgagtgcagtatttacttgtcaggatatttgtcagcacaggcattgagatttccaagtttcacagatgcaacttagctcaattttttaaaaattgcctttgtcctgacatacacattatgttggggacccttagacttataggcaaatatttgcaatcatgtgctgaagatgtgaaaaattatcatgcatatcaatgatggaataaaaaatgaaatctattccttctcctcctctttattcagtcttttccccctctttaaacaatgctcggtgggtcaggacatctatttaaggaagcagggaatacaaaattcctcctgcatctaagaattaggctacacaagctgagtcctcgctgcaatcctccttcttattaggacatttccattctcaagaggatttgaggaggggttttgtaaatttactgagtaattgtcatcactggacttcatccatgattctagatattaaagtcactctgggatctgtcaggttattgataaaggttggctaaagctgaaagagaacagatatgagaaagaataagcaggagtagaggaaaagtggtaaaatagggacaaaagaaagaaggaaggatgagagagaggaaaagggagggggagagaaaggaggaaggagaagaaaaaaatgcaatagctcatctactcagtgcagctaatatcctcctccctgacctgagaggactacattttaaaaatctgacaagtaattcaatctccaattaacaattttaagtggtgctgcacatatcactgtgtcaatgtttcttcaggaatatatccaagggtgaatggaattaaatctctagggagatggaaccaggacctatgtgaccaacaagattatttgggggttccaaaatacagtttcttaatgcataggcaaagggttataattttttccccactttattgccactactgtcactggcaaactggagtgctggctggcaggtgctaggctagggttggggtagagaaggggctcggtgacatactgtgggcagaagagagaaaagcctctgacatgagccacagctggattcaagaccatttgctataagaccaaaaatctctctataagcagcaaatcatgaagtgatcaggtatgctgaaggataaactggggcaaaggggtggtactgtcagtggaaggaaaagaaacagccaaaaagaggctgaatataggccagaaataacactggaagacatctctttactgaggtacagggctcagtggagaacagaggaatgaattagacagcagaaagacaataaggatttgaaggtggagtgggtaaggaacagagactcatttgtaatgtaaaagatagagaggagccacacaatagtttgctaaatgtatgagaagaagcacaggcttctggaaagaaagctgccaaaagtaatcactcaccctagggggacccaccaactgctcatgtaggtagggacttgagatttctgataagttaattccaaacaggaattcttttttttttttttttgtagagacaaggtcttgcacgttgtctaggctggtatcgaagacctggcctcaagcaatcctctcgcctcagtttcccaaagtgctgggattacagacatgagccaccatgcccagccaatttttaaaaattttaaataaagtctggtttattgaagtataatttacatacagcaaaactgtccatcataaggtatacaagtctgtgaattttaatacacatagtcatataaccaccacaacaatcaagatagagagcattttcatcatcccaaagtctcctcatgttcccttccctccctccacccctaacaaccattgatctttttgttccagtagttttgccttttctagaatgttacataaatggagtcatacagtacatagccttttgaatctagcttctttcagttagcatattgcatctaagcctcattcatgctgatgcaggtatcagtagtttatttttattcctgagtaatattccattttatggaagtaccacaacttggtaacccgtttgcctgttggtgtacatttgggttgttttcacttttggaggattataaataacactgctatagacatttgtgtacaggttttaagaaaagcccaacctttttcaaagtggctgtgccattttgcattcccaccaacaatctatgagagttccagctgtcctgcatcctcatcaacacttggtatttgtcaaacattaaaaaaaaaccatttaggccaggcacagtggctcacacctgtaatcccagcactttgggaggcctaggcaggcagatcatgaggtaaggagattgagaccatcctggataacacggtgaaacctcatctctactaaaaatataaaaattagccggggcgtggtggcacatgcctgtagtccctagctacttgggaggctgaggcaggagaatcgcttgaacccgggaggtggaggttgcagtgagccaagattgcaccactgtactccagcctgagcgacagagcgagactccgtctcaaaaaaaaaaaaagcaaaaaacaaaaaacaaaacaaaaaacaccatttagtggtgtcaagctgtggtttaatcttcatttccctaatgactaatgataagcatcttttcatgtgcttatttaccatccttatattttctttggtgtaatgtctgttcaaatttcttgcccatgtttttaattactgggttgttttcttactgagtttgagaattcttttggataccaatcttttatcagattatgtattttctaaagatggaaaacttttaaaaaaatccctgtttgtcagtcgcctcctactggttttactgaataggctgtgactgactgcattgctcaccagtgtccaggccccaagagtatggtgtttgcagggcctcgctcttaggggagtagcactgacttactatctctgtggccttttggtttgtgttttctcattgacgtctgatgggcagcaattttattttttcctttagaacacatgaaaggcctattattgtcttttagctaaatttcagctccatgaaagcaggaatcatctttgtattgccacagcataagaacagctttatacctaacaggcatgcaataaatgcatgtgatctaccacatttctatgtattctataaaacctcaactgattagtatgttcagcaagttaaaccactataagcaaaataagtctttcatattagtgttataatgtgtagtggctttctgaagcaaaaggagtggttcaattttcctacctttttagttttccccaatgtagatgcccctctccctccctccctgtcaaaattctttacatgggctaaaattaaactagtaattctaagtactataaagtcatattatgttaggaatgctcttctgagctgcataaacctgctttatctattgagaaaggcatattttaccaatgggtcaggtagaaaatgaagttactcaaaagttgattacatgttccaatggtcttgacttctcatatttgcatcttatgctgttggttaaatttgggtgggttcttttccttaccaacactgatttctcaatttcttagacgcgcatactattttagaaggcttaaatcccagacactgagacattattaaaattaggaaccggtcaaaaatcagccagaaaatcttgaagcccaggcatggtaatctgtagttcaatctaaaaagctctttaagcttctcctttcataattcaatattcctgactgtgtacattagctgattagactgtgtgatgatggccaatctgaatgagaagggacatagctagatttggatccatgcacagggaacattccctagaatgatgaacagctaggagtcaggtttctaaacagtctcatttccgcttctttatcatattcatagaccagtctgtgcacagccagggcccagctctgtcttccttctagaaaagactggagtccttgcatttctaatctactaacgtgtggttcttgcacttttaatttatgagtgttaagggggacctttctgacttgggaacatattggctcggtctaatgcttggagattattaaacttggagctatgctccactatcaagtctacagatcttttatttagaagatatggtgctctaaatgcacaaagagctccctgtcaccttcacattaaagcccctagtgcctggtaaatggaattatatagctgtcatctcctttccccaaagttgtaagagtacaatgggctcattttttcacactccatcccagcttcagaactaagagacctactttgtattgatttaaggtctcagaaataaataaacctgcttcaccactgtgattcacaacaaattcatgatacactattgcatgatatatttcaagctcttgctctggctctctttttcttctggtgagtaatgggggaggtgggaggtggtagggagctgcaaagctgacagcctgatggttattggagatggttgctgactgcaaatccaagaatagacactgttggaggagtacgggaatttttttacaactagggggcaggggtgataagctaatttacttgggcttcaggctggggttgggggagaagaaaggctgaagagaggagaggggttgacagagtagcaaagcttcaagtgagcactgatctgcaaagacagagctatgaatatatgtagaaagagagacaggtgaagaaaattcaacatatgaaggtgtaacacacaactgaatataaaatgaagaagacgaagaaaccaatcttcctaaggaaccgtgtgtacagagctaagtgggcccttagcttgagttcagagacaatgttttattagaaacagacagtgtagagaccctacatgccacccaaagtgtgaggtagaggcatttcttcattctaatactcaggacacatcagaaccctggaggtggaaatggacaatggatatagggtagagatataatgaaggtccacatggatgaagtgagccagagactgttcactgaggcaagagggtaatacattctagcagtttagcttgtgtttgtgtacccttggggtttgagtacctaagtctacatcacctttactgattccaccaaatcttaggcccaatgagttttagctggtatctacaaatatagcagtcaaaaagaaatatcctccaaccttatttcaggatctggactttcaacaaggcagaggaggagaaagcaggagataatcgggctccgaaggtactgcatggcactgcaggagacccctaaggttccaaggagtacttccaagtggaattaagttttaactgtttctcttgtttcttctacttatttcacatttttaactggcaaagttatttatgaatccaatttcttttctatcttggaatagcattttcatcttcactacatttgttcttgagacaagaccagactctgaacacaaaagtacatgagaaagattttggttccattcaatttccaattggtcatatcacaaaactgggagtttctttgttaaatttgaacactgtctttaaagagtgatcagtctctgtacagggaaacagactttagccaaatataaaaaagaattcacagatgaatacatagatgaatgggattggctccaaaagtactcagctcccattcagttgaatttttcacacataattgggtgaatatttagcaatggtgtcacagaggagattcacacaacaattgtgtggttgaacttttgaggatcctcccactctcaagatttataattctacagccacttgtgattgtgaacaacatatagtgtttacttttctgtaatctggataagaaacaaaattaaaaaaaattttaaatcatcatgctcttcaacttccattcctggtctcacgagtatgtaataattttatatatcactaatatgtaattttatatataataccctaatacgcaataactttaaaaattccccacctcctatctattcactccccagcctaaaacagttccctggctacagatcaatatgcatctttatagcatcacagaatactagatattgaacagaatttaagattaagagatcctctggtcttctacttaaaaaaaacaagcaaaccaaaaacaggcttaattcactttatttttcttatgtaaaaactctgtgttgtagccacagttggagcctgggtcccctgcatggagactctggtgtgggtcttgatgaggtggtcagtgaattcctgacaggaagacttgatgaatacagtctccttccagaggtcgggggtcaggtagctgtaggttttagagatggcatcaaagatggccttgagaaagttccctagggtggcagtgcagcccctggctgaggtgtagcagtcatcaatactggccatcatcagcagcttcttgggcaccagggccgagatgatgccagtgccccgggtgcagggatgaggcgcaccagcacagagccacagccacctgtcaccttgcaaggaatggtgtgggccttcttctcccagtagcctctgtgcatggggacaatgaagagcttggccaggatgatggccccatggatggcagtggccacctccctgaagtacttaacacccagaccaacatggccattgtagtccctgatggcaacaaacatcttgaacctgatgtgctggcaagcacgcgtctgcttctgcactggcataatcttcaaaacctcatccttgagagaggtccccacgaaaaagttagtgatctcagattccttgatgggcagggagaagagatagatctcctccagggacttgatcttcatgtccttgaccaggtggcccaacttggtcatccattccttgccctcagccttgcctccatgagctctgtggggcccaggccctgttcacggccatggtcccagccctggatgccactgccaaaggttccacggttccccatctcaggcacccccacacctggctaattttttaattattttgtagagggggtcttgcttcttgctatattggccagcctggtcttgaactcctggcctcaagccatcctccttccttggcctcccaaagtgcttggattataggattaccacgccaacctgattttctactttaaaatgggaaatgtattatgccttccatttcacaaagaggaaactaacatctaaatagattaaagcccaaagttgcttacctagtaaatgtcagggagaagaacaatcaaaagttttttgtttttttttttctgagatggagttttgctgtttttgcccaggctggagtgcaatggtgcaatcttggctcgctgccacctctgcctcccaggttcaagtgattctcctgcctcagcctcctgagtagctgggattacaggtgtgtgccaccacgcctggctaattttgtatttttagtagagacagggctttaccatgttggccaggctggtctcaaaccactgacctcaggtgatccgcctgcctctgcctcccaaagtgctgggattacaggcatgagccaccatgcctggccaagttttttttgttttttttgtttttttttttttaatctaaaggttctgtaactccaaaaaatttgagcacattcataataggttgtcaaacatgataatttccgagtctgtattcaatgccccaaatagagtctcagagctttcactttatctagaagctctggactggtacttgctgtagggtctcccaaattcttagactctaagccaccatatatgcatgggctctcttagagtcagagacaacttctgcagtggagctctgtgtggcgattccaccctgcaagatctccaaaccagagcactcaggattgttggcaggtcactaaggcagactaatagagtcaaaacataacctggtatagttttctaccaaacttgaggaatattgaatgaaaaacaaacaaaataatccccccaaatggggccagatttaccaatattttatgtgtggggagggagcgcttgaaaattagggagatctgtccattgtgcaataatttctgagaattcattcataatgctaaagcaaggattactcagaaaggaagctaaaatgccctctttagaaaggagagtgatcccatctggagctatgggagtacagggactgtctattgtgaaaataggtagttagggacttttaaaaatgcaaattgctagactgatccttagagtgattatgagctattgtatcaacgagtccttggggactcttgtagacagatgactgacatatatactaccctgtcacgactgaacatcgtgcctctcacattaatggctttccaaagtgcgttgattgttgctagatacatctattgggaaagtcaatacatgaatgtactgccacagtgaggactgtcatctaacattttctggaagaaatttttgccttcaaagaatcagaaagtatagagaataatgtgttcgtatttcctttccagaaccaggataagaaattgcaatgagaaggaaccctaaatgaaccttagagaagactatggcagtgccaatgttttacctattttggctcatttaattctcacagcgactctggtacacagatactattattactcatcttttacagttaataaaactgtagcccagagaggttaaataaattgcccgaggtcacacaactaagtaggtggtagagccaagaattaaacctgggcagcctggctctagcctctccatgctcataacatcttttttttttttttaactaataaaaaaattgtaatttacttagaagcattcagaatgccaacaaaacagctgcaactttttttttttttttgcaattacagagtggtattcagttaacagaacaattgtttcatataagctgcatcagagacaattgaaaatgaaaaaactaccaaccccatatataacttacatgtgctgtgcaccaataagaacctgcttaaaatttttatgccaatttacaacccccatcctgtaccaggcaaggttagtggctatgaaaataccaccaggacagggctatctaaagacacttttggtagtgtgttaactatacaaaagaagacaccatacagtttaaaaaaattcttacacagccttacatttcaatttttttctttaaaaggagtgagttgtatacaggggggttaaatgctttatagacaagaaaaaaatctgtgctagaaccaacttattcatcatcatcatcttcttcatcttcctcctcctcatcctcttcatcttcctcatcttccttgtttttcttgctttttcggccttggcaactcccttttttgctgcatcaggctttcctttagctcaatatgcagcagtatccttttcgtatttttccttcagcttcgcagccttcttttcataaggctgcttgtcatctgcagcagtgttattccacatctctcccagtttctttgcaacatcaccaatggacaagccaggatgttctcctttgatttttgggcgatactcagaatacaacaggaagaacgctgaaggaagcctcttgggtgcattgggatccctgaacttcttttttgtctccccttcaggagggacgtaggttttcatttctctttcataatgggtcttgtctgtctttgccatatcttcaaattttcccttctgtttagcagacatggtcttccacctctctgagcacttcttagaaaactgagaagttgactgaagcatctggatgcttcttatgctcctcccaacaagtttgcacaaaaaatgcgtatgacaacatcttgcctctaggcttcttaggatctcctttgcccatgtttagttgtttttccacagcgaggcacagagtcacccagtgcctgtctggctctcgcttgccccggcgctgtctctatcgtaacctctttaagttatgtgaaagttacaatgctgcccgccccacagtgagagctaagtaatctctccttcccttcttgagcctccatgactttcatgctgtgtttcacagagtcatgggtgggtgagcatggagactacacagtgcaggtccctggtgtaacagacaattcccactcctgagaggaactctggtactgtgcctaacagagtcagctatgacaacttcacatttcatactgcatagctgcagaaaaatacatatatgagaaccagagagaaatgtaacttacttgcaccaagtctcaaaagcaagattagcagaattagccccctaccaaactaatggccctagtcatacccatcacataacttcttttttcctggcagattcagtggaaataggggcctgatctcgctaagggggatgagagtataggatttttttttttctaaaaaagaagcagagctttaaaatacaagaaaagtcacatatcatctcccggtgaatctatcacctgcatatcactgcctttggcatataccttaccttcacagtcagttaatgtccacaggacaaccataaactgcatattcttatttctctggatagagaatgtgctctctctccccaagtctggggcaatggattgagagctagtaggctccagtacacatcagtgttcctttacaatactagctcttcccagcctatctgccacctaacactatgttaaacatactaatacttttaccaggaaagggagaaaaaaataaagtaaaaaggaaactgagaggaagagtggtgggaggagggaagtaaatatgatcatctctgcaaatgtccagtggcaaatagacttaagagtttatgactctgcaatcatctcagctccttaagggtgcatcttaacagttccccaagtacacaggttactgcctttgccaggccagcatgactcccttcaagcagggtaatttgccacacacatcaggtctgccacgcagtgaggcattttaaggaatctgtcacccacagcctacagttcctagagttaggatctactaccttgagtgacatgaaatagcaagcccctagaaacttctcttattaatgtcatcattctcacgacatttggacaaacaggaaaacgaccggaccaccttctcttaggctttacagaccactaagcaaagaggcctgagctttcttcagtgaaacttagggacatgaaagttcatgttctgaccctgatctagtctctctcaatgaaactaagtcactttcccttctgtttttgccttcctgtctacgaaatatagccctgataccattagcccattccagaagatagcaaggaaccagacagatattcttgactgaatttcaagcaaacccacttgggctgcttctaatcaccagcctactgcctttagttctaatgtcaaatgtgcttagtaacactcaataaaatccagatactacaactcatctcaatttgggtaatattttgaatattttacaaataactgcaggcaacaaagcaagacagacatggaaagaagatacacaaatggtgagttcacagggggaaaaggataaaaatacgaaggtgggaagcacttcctggttttggaataaaagacacagtgacaaaggatggcgtccatgaataaaacatgtaagtatacagaaaaaccaccaaaagtaaaaaaacaggaaaacaccagaaaatatttattttatatgaaggttactactgttggctataaaaagaaatcctttaaaaagtaagagtctttggaagcaaaagataggaaggtgtaaactaattaaaaacaggctaatgacaggcaacatcatgtgtatgccaagatggagtatagccataaaagccaggcgcacacatgcaatgtattaagttgaaaatgcatgtctcttcagcttcatatctattaaaggaagaaacaatttacaggttgctgcattatgggagtatgatatgtggagtgtcaaccttttctcttcaaactgaaccatgttaagtaaaatcaatgatggggtttggggggtaggggaaggaaggggaaaagcagggagaaagaaagtttttaaaaatctctgcctcagcaaaagttttcattaaaattttagacaaatcatccctgtgtccttctcccttgctgcctggggctccatgctatttctatgcaaataacaacctcgtggtttatatcttattatttccaccggagctgcagcgacatgacctgagatgtgtaagaggtgggggggaaggggggggcagaggaggggatttggagaggagagagaaagggagagaagaaggaggggggagagagagagagagggtgttcactcaagtgtgaaaaaatattgtcaggagtgagcatcaagaacaaaaaaaaattgcagggataacgtgtttatttcagtcccccccaaaaccccccaaccccccttcctgcaaaccagcaccttttaaaattcattgggcatcaggcgatcatgcacaatccatctgctttcactttatcatttgcatttcatgcctcctggcttttgatgtgctgatactttgatgcagtcaggagacgtgcattatcattatttcaattttcaaaggggtcaacaggatcggcacttgcacacacaagatttttttcccctacaacctctgaacacccccactccttattcttcaccccaatgtttaacataaaggatgaagactcaaaaatgtgggggtcaaatatttacagtctaagactgtatataagcttgcatgtctcctacatttccaccttacacaggtacatactatgagcaaaatggccaaggcttaagaaaggaggctctataatgtttcaaaaacacaaagactttctcacacatgaacacacagggcggcacacagacagagaaagagggggatctatacgcaagacacagacacaaagagacagaaagatcagcacccacacagaaagagacatgcactcagggtgacttgcacacacccaaagtacacaatacagagagatacctacagaaagaaaggcaaacagagatgaagaaaaacaccagcacacacaaagacaacacacagaaggagtgagtcagaggaagccatctgagcatggtagtttccttttttcataccttataggcaaaggggctaataggatattctgaacgaatttgcataaaatcgggtgtcttcagcagcacagctctatacttaagaggagctgacatgaagatagtgaagcaggcagagcaacattaggtaacctctgtatctgatcactcccttcagctaaaaacaaatatgcccttttggaagtgagcattgtttggtaagttaaagctatagctttatttatctttcaccctgtaactaagcttttgttttaacaagcagccctgtaagctatgacagtgaatataatgaatttgattagaacaattcaatcagattttaagaaatcaatctctaatgtttcttcatggcacaaatgaaattcaactagcaagttttcaagcaaaacaaaaccaaaaacccaacatctgctttttgtaatattctttgtatataatatagtatcggggcaggggggagaaagaaactcaatataagaagatatatttcagaaattagctctctgactgggtatgggaacatcatggaaatataggtttttaaagtaccattatctatgagaacagaatttttaaaatctttcaaaaattctgttctcatagataatggtacctaaaattatctttggcattcatcaatatctcatcctaagaaggtatccaaaagagcaacttaaaaaaaaaaaaaacaacaaccttaagactctcagcagtttctcccactgcaataataatcttcagtagtagtggttcacaacctttatttccaggctactctccaaaaagggaggaagacagccaagttcgccactgttagcactgctgtgcctttccttgatgagaaaagcaagcccagaggaggatacagagttcatatgaatgcacagagcaagctgatcgcatcaaatgattcctctaatttctgacatccacaaaatctaattaaaccaatggaattatcaactttttcctaaatgggaatgacagaacacttaattcttacccttaaacttgaaagtcaagacttgataaaaagttcctgcaagtggagtaaacataatatctgatacaatttagtatgtgtattaactccataagctcaatcaccaaatcatgttagagagaggaacgggaaactgaaatttgaatgtgggccaacactttttgccaagaactaggtactctttttttttttaagagatggggtcttactatgttgtcaggctggattcaaacttctgggttcaagctatcctcctgtttcggcctcctgagtagctgggaatctaggcatgcccagtagaactaggtacttttacttatgttttctcatttgagctccacattatttaaaggtttaaattattatccccctttgacagataagaaagctgaggagctgagaggttatataagttgcacaagggcagtcagcctcagaatattccattatacttttctggccctgaagagaaaataattttcctatgcttgcaaagatgtcagaactgcactgtcctttatacattcaggtattcttggatagttttcactctttcgagcagtgaccttgccatccatttttttcccctttggaaaaacccttgtgaagttggactaaaaaggcacaaatctttctttggaagggaagataaatctttatgcatactctttcccagtaacccatccatgcatccatccacccatcttcccactcaatatttgccaaatatttcttctatatacaagagaccaccatcggtgcccttttcgagaggtgtatttacagatttcacaaaatcattaaaacttgatagtctcaacacctaggccggtacctaattcatgatgtaggcctgaaatgggaaccagcacagctggaatcagagacagctcaatgtctgtgtatagatctcctcacatcttttactaatagattaagaaaaagagagaagtgggacagaacagaagcgttcaattaattctgtctttctacaacgacactaaaacataagcactttagagcagcggttttatatggtttgttcactaacatatacacagggcttggaacagtgcctagaaaacagtaagtactcaaaatagttgataaatgaaatgaatgaatgaatgaatgaataaaaaggcaagcaagtcaatgggcagaaaagatggagggagaggggaagagatagactgaggaaggcacggattgaactgcttccttccaatcaggatcttgaattaagaattcacacaataatcttcaatcagctatgcatacttcttcaaaaccctagaaacttactttgttgagggctccagctcctgttagaattaagtgagaattctcaacctggatggttctctgtcccagccggacaaggtaagccccaatcccaatggcccggcacgtcaccttagaaaagaataaattctacatgtcacatatttatgtcctctctgaagctataagaactaaggcatagataagtaaaatccaaattaacagaaataaacattgctttttatgaagtctatttgattgacaacaacacacacacacaaatttcatggtcaaagaaaagaaaatacaatgatgcaaaattcaggctgggtgcaatggctcatgcctatcatcctagcactttgggagtctgaggtgggcggatcacttgagcccaggagttcaagactaccttggggccgggcgaggcagctcacacctgtaatcccggcactttggaaggctgaggctggtgaattacttgaggtcaggagtttgagaccagcctggccaacatggtgaaaccctgtctctagcaaaaatacaaaaattatccgggcgtcatggcacgtgcctgtaatcccagctactcgggaggccaaggcaggaaaaccacttgaacccaggaggcagaggttgcagtgagctgagatcacgccactgcattccatcctgggcaacagagtgagactctgtctcaaaaaaaaaaaagacctacttgggcaacatagtgagacccccatcactacaaaaaagttaaaaattagttggaggtggtggcacatgcctgtagtcctagctacctggaagctgaggtaggaggatcacttgagcccagggggtaaaggctgcagtgagctatgattgcaccactgtactctagcctgggtgatagagtaagactctgtctcttaaaaaaaaggaaagaggggccaggtgtggtagctcatgccggtaatcccagcacttttggaggctgaggcgggtggatcacgaggtcaagagattgagaccatcctggccaacatggtgaaaccccggctctattaaaaatatgaaaattagctgggcatggtggcactcgcctgtagtcccagctactcaggaggctgaggcaggaaaattgcttgaacacgggaggcggaggttgcagtgagctgagatcgtgccactgcactccagcctggtgacagggcgagactccatctcaaaaaaaaaaaagaaagaaaataaaaagaagttacactaaaagctaaaacaaagtgctgggtttgtttgaaaaattcagttatttatattatcctatcttcctattatcatgtgtgattaaaatataattatagacatacaatcttcaagaaatgctctcatttgggactgaatagcagtgataagagaaaaaaataaacctagccacacagccagttcttcaaaaatttcacattctggaaagatttaccaggctgatggtaatgatctcattataggccaatgaggattctccagcaatcattccagaacctcgaaggttctcgggtccaattccctcttctttcccaataatatctgttatcttgtacctattggatatggccatgtcaaattatgaatgttaaacacagtaacaacaagccattaaaagaataatcaccaataaaaggcggctaaaagtgtattgaaagcttatatttaatgccagggctttatgtgcttccttttatactcttcattcatatgtctttccttcttagcttggtgcctattttacctggaagcaacatggtttaatagaaagagcgaaatctggaattaagcagatagccttttttctttttttttgaggcggagtctcgctctattggcaggctggagtgaagtggtgcaatcaaggctcactgcaagctctgcctcccgggttcacgccattctcctgcctcagcctcccaagtagctgggactacaggcgcccgccaccacgcccggctaatttttgtattttcagtagggacggggtttcaccgtgttagccaggatggtctcgatctcctgagcacgtgatccgcccacctcagcctcccaaagtgctgggattacaggcgtgagccaccgcgcccggcctaatttttgttttttttagtagagacggggtttcaccatgttggccaggatggtctcgatctcttgaccttgtgatccacccgcctcggcctcccaaagtgctgggattacaggtgtgagccaccgcgcccggccaagcagatagatttaaatccttgctctgatacacacaggagtgtgactctagaaataataataacttctacaaaatgggaataataatatctacctctaagggttgacaagaaagttaaactaaagcaaacaaggaaaaggtttgatgttatagatggccctcggattttagatgccctctcttattttctagaacaagtttcttaaaagcaaggtcaatgtatatctctataatgagcaaaaggcatcatatcaacaattttagacaattttacgtaggaaaagaatatccaaacagagcggtagtgagaatgctcagcttagtttctcaagtcaaaaatcctcttctaaggtaggatgaagcaaaggtcaaaatactgaactcccattcatactccttcataaatatcaagtatatacacaagggtccctggatatgtcctctggaggggaaggtggaatgtgtgtagaagtgaaatgctgaccaagttgtccagaaagcatcctgtggatctagtgggagtcactcatctgtcttcctggcaggggattaggagtgatagctgataatgggaaatgggagatggggaatgcaactaataaaagaaaggaaaaatacaaagttggaagtagagatgggcatatattatttattgttccacgtgtacccagaaggcttggcagtgggcacagttttataaattgaaataataaataagtaccccatagtggctcttaaaatacttcctcctgcccccatattttcctgctcccttcttcatttccagccctccatcaattctttttctttgcccttgctgttggtctgtgactttgcatctctgcttcccagattctgctgcctttctatttttagcctctcctaatatccaataatttcccagttcttccttttgttctgtatctagactctatcctaaagttatgtcagaaatgaggctactgtcccttaagggggttaattaactacattaattgtatatgtgtttgtgtgcctgtttgtataaggtccatatagtcataaatattcaaggacccagccagacttgcctgtaacaaactcaatattcatagattccagaaatgaagagttaaaaaatatcataggggaaaatcccattcagagtagcaagaaaaaatgcaaaatatttagaaataagcatgaagaaattggcagaatctcaccgtaactatattgtgtctcagggcaccatgatgaactcccagaagcactacaagatattttaaatttttgagagaagcactattatatgtggtatctgtgaccctatgtgaactactagctttagatagttcatagtagttcacagtttaacgttagaatggtgctacattccttttgaaaatgtcctgtctttgcaagctagatttttgaagtttctgtgaaaactcaatgaagaacaagaaatgtgggtggctatatccaagctgattccaaggtttgagaggttatgcagacacaaatatctcattagtaagaaactgtaattatttaagaataaattttttcgatttatgtatataattttttcaaatgattattaagttcttaggacgcaaatacttattgtttaactacctaataagcagaaatattaagtatatcttatagcccaggggtgctatgaaaaaattactgagacactaaggatgccatgaaccaagaaagtttgggaacctctggcaaaacctatatgaagaaaactacaaaacgtaaaaacaaaacaaaaaaaaccccactcatataaatggaaaaacataccctgtttctttttggggaaagttagtattatgaagatgtcacttcttaaattaatgtgtaaactcaatacaatctgaatcaaaatcattatggaacttttttggaattagaaaaacatgagactctagccaaacacagtggcttgcacctgtcattgcagctacttcagaggttgaggtgggaggattatttgaggtcaggagttcgagaccagcctggggaacctagcaagactctatctctaaaattaaaaaaataattagctgggcatgatggcacctgtctatagtcccagctacttgggaggctgacatgggacaatctctgaagctcaggagtttgagggtttagtgacctatgatcacaccactgcatcccagcctaggcaacagagtaaaaccctgtctctaaaaacaaaaaccctctacattaaaaaaagcaaaagtagccaataatacttgaggaaaaattaaaaatgtgagaaaatttgcctcactagaatagtttaaatagtgtggtattagcccaagagcagacagacagaacaaaaaaacacaaaagagtaaattttcagtaaatagtattaggacaattaacttttttttttcttttttttgagatggagtcttgttctgtcacccaggctggagtgcagtggtgtcatctcggctcactgcaacctctacctcctgggttcaagcgattgtcctgcctcagcctcccaagtagctgggattacaggcatgtgccaccaggcccggctaatttgtatatttttagtagggatggggtttctccatgttggccaggctggtcttgcactcctgacctgaagtgatctgcctgcctcagcctcccaaagtgctgggattacaggcgtgaaacactgcgcccagccaagcaattaacattcttaaaaatacttgcagatagattatataaaaacattcaacttcactgggagtcaaaaatacaagttaaaataacaattgccatttttattccattttattaattgataatcaatgttggcaggggtgaagaaaaattaaagagggaaacaaatcctattctacactgctgacagaaatgcaaatcttgggaaggcaatttaaaattattttttaaaatccttaaaaattgacttttcgacctgcaatttctcttctagaaattaaccaaaaagggatgatcagagcttttaattcctaaaagtttatatgaaacttatataaatgtcccttaagtgggttcagccaagggatgtgaaaaattagaaatagtctgaatgttcaaatatatttattataataaaatactatgtagacattaagcatcatattcttaaataatgttttaagaatacacgaaatttccccaaaaatagtttttagtgaaaaggataaattataaaagaaattcttgttatcatctcaatcacatagaaaaaagatatgtctatagaaaagacagcaagtgtataacataaattcataatcgtggcctgaaggtgggattgtggctaatttttttttctttataattgtttacatgtttcagtttttctaaaatgaattaagtattataaatttaaaaacttcaatcaataacccaaggttcttcagctaataagtggtagagctggatgtaaacctaaaacatctagattatgtcatcttcaatgttcttcaaggttatgaacagctgtacaatatggaaaaaaataccatattctcctttctttagtcatgaccaaattattccaatacatatatacctacctggattctccttcatcttccacgtgttcacaatggacagagttgagagcactgactctcttataatcttgaggagtcagatataaatacctgtatccctgtgaagcacaaatagtttttaactcattatttgccattgtcatataatcagaagatacagcaaagcatacataatgaagcttgttccacagctagctttaaattgccacatcacttcttaggtttactgtctaacagaatactagcacagacagtcctcctttgaaagatgaagtgcctattttttcactcactaactgtccttgaaacaagacaccttatagctgcaattccaagtatattcccttcatttcattttctttctttctttcttttttttttttttttttgttgagatggagtctcactctgttgcccaggctggagtgcagtggcgcgatctcagctcactgcaagttccgcctcctgggttcacaccattctcctgcctcagcctcccaagtagctgggactacaggcacccaccacctcgcctggctaattttttgtatttttagtagcgacagggtttcaccgtgttagccaggatggtctcaatctcctgacctcgtgatccgcccgcctcggcctcccaaagtgctgggattaaaggcgtgagccactgctcccggcctcatttcattttcaacagggttaaagggtcattttctgatctttagtgacatctcttaaagatatcaacatgtaattaaagaattgtgtgaattactatttttcactctctcaaatccacaggatcatcaaaataaatataagcaagggataacagaaaaccgcaaatctaggagattcaatattaaaatcagaagtctacacagtgctaatagtgaacactgaactcagatcttttgttttttcaataaacaactcctaatgcccatttacatgtaaacaattatactaacatttcataattgatttatatgtatctatacacacagccacatacaaagtagagttacatggtatatgtgtttaacttaagtgaattagtcactcagtcaaaaaaataagtaaacacagggaagcattttaaatactatgagaaattatgcccaccatttaactcaataaatgtatgtcccacagtgagcacaacatggaaaagacataaatctgcgattggtcttgcatgatttgtgttgagaatgcctgacagcactgagtgtcattagtatgtcagtcagtacacatttactgagtgcctattatgtacaaggtactattccaggcactggaaaaacaggaattaacaaaaatagacaagaattcctacccttatgaaacatacctcctactcggaaagtcaggaaatacacaaaataagtaaaatgtataatgtaaatgggaataacgtttaaggaaaacaaaatgaaagagaaggtagacagtcgaacttttagaaaaaataaccaaggaaagcctcattgaaaagtgtcatttgagtaaagacctaaaggagctgaggctatgagacatgaggatatctgaggaaaaagcattctaggtagaaggagcagcaagtacaaatgcactgaggcatgatgtgcttcgcaggtttaagaaagcagagtcgggtagagccaatgtgtggaatggtcaggggaggctgtagcaagaaatgagggcagagtggtactggaaagccaatctatgtaaggccttgtaggcaactatatgatctttggcttttacttgaatgaattgggaagctattaaagggttttaagtggagaaaaattttgtgatctgatttatattttaactagatcattctatcttttttttttttttttttttttttgagcagagtctccttctgtcacccaggcaggagtgcagtggtgcgatcttgactcactgcaacctctgcctcctgggctaaagtaattctcccacctcagcctcccaagtagctgggattacaggcatctgtcacaatgcccagctaatttttatatttttagtagacagagggtttcaccatgttggccaggctgttctcgaactcctgacctcaagttgatccatctgcctcagcctcccaaagtgctgggattacaggcatgagcatgagccaccacacatggcctcattctacattctgttgagaacagaccttgggtggggctgggagcaaggccagaggcaggaagaccaattaggagggtactgcaatatgcaggtaagaagagttagactactgctactgctagtaagtagctgtggaatttgttagaagtactcagattctggatatattttaaggtagggatgtaaacatgatttactgtttagatggatgaatggggtgtggaagtgaatgtggggtgtgcaagaaagacagaagtcaagaataactccaaggtcttttacttgaacaaatgaaacaatagaggtaccatctgttgagacagaagactgtgggaagaacacattaaaggaagattagaagctacaatttaggcagacatttaggcagatgtaagtagagatgttgagtctggatatatgaatcttgtgttcaggggtaagatataaatttggaagtttatcagcttgtacatgaaacttaaagctttaaaagactggatgaggctgggtgcggtggttcacacctctaattcctgcactttgggaggccaagatgggcggatcactttgagctcaggaattcgagaccagcctgggcaacgtggggaaaccccatctctacaaaaaccaaaataattagccaggcatgctggtgcatggttgtagtcccagttactcaggagggtgaggctggaaaattgcttcaacccaggaggcagaggttgcattgagccataatcgcaccactgcacaccagcctgggcaacacagtgagaccctgtctcaaaaaaacaaaacaaaacaaaaaaacaggatgagatcaccaagggaaggtgaataggaaaagaggagtagtccagggaccaagcccttgaatcacttttttccttctaccctactttctatattggctgtcttgccaaaccaccaggtgagagggcattgggtcctagtggggttgagaatggggagtccagaacttcttggtcctgctgcagcctctgtgctcctgacatgtctccattcacttttttttataattaaaaaaactggccaggcacagtggctaatgcctataatctcagcacttggggaggccaaggtgggaggatcacttgaggccaggagtttgagagaagtctgggcaacacagcaaaaccttgtctttatgaaaaataataaaattagctgggtgtagtggtgtgcgcctgtagtcccagctacttgagaggtggaggtgggaggatcacttgagcccaggagttggcagatacagtaggctatgaatgtgccactgtactccagcctgggtgacagagctagaccctgtctcttaaaaaaaaaagagataaaattaatataacataaaattaaacattttggtttttaaagtttttttttagtctcactctgtcacccaggctgagtacaatggcacgatcctggctcactgcaacctccacctcccgcattcaagcaattctcatgcctctctacctcccgaatagctgggattacagacgtgtgctaccatgaccagctaattttttatattttagtagagatggtatttcgctatgttagccaggctgatctcgaactcctggcctcaagtgatctgcctgcctcggcctcccgaagtgctgggttactgcaaccagccaaaattcaccattttgaaatgtataactcagtagactttagtatattcagatgttttgcaaccattaccactaattccagaatattttcatcagccccagaaaaacccctgtactggatcaattcccatactttaataaagtttttctatgaactttattgaaatataatttacatgcaataaaattcatcagttttaagtgttataacttgatgagttatgacaaatgtatgtacttaggtagccaccaccacaatcaaaatatagaatatttccatcatctcctgaaatactcttacatttaaagatgtgaaaggcagcaaaggaaactgagaaagaggagccaggaatgcaggaagataaaaaggagactttgggctcttggaagccaacagaagaaagtatttcaaggatgaaggaatgaccaactgtgtcaaatgctaatgctattgtcaaataactaaggtgaagactgagaattcaccatagaattcagtaatatggaatcactggtgaccctgacaaaagcagcttcagtggaatggtaagggtgcaagctcaagtgaagtgggttcaagagggaatgggagaagaacatctggagacagcaagaacaactcctttaaaacaattttcctgtaaagggaaggaggggagggacagtgactggaggggtgtttgtatgctaaaagggctgatacagtacagagggaaaaagtgctgatgcacaaaagagcaggaggaagtgttgatcgtacacttaagttagcaagaaaggagatcaaatgtacaagaggagggattgtctttagacagaagtaggaactattcattcaaagtgtggaagagaaggtgaagagtaagggcacaacggatgcaggtacatggaagcttgtagaagctctcttctcattgtttctcttttcttgaaaattgggaagcaaggtctgatgatatcagctaagagtggggagagggaagtgcgtgttacaggtttgaggggagagatgtgaaaccgtcatccaggaggttgctaagcttgaatttaaagtaagatcagtcaacagaactgtttttttctccatcaaagttcagctgggcaggtgcaggcatgggagcagaatggagagagttggatttaaacactctgtaaaagcacagagtaagcagagtgaagagagaagcaagttgaagcaagttgagagagaaagttgaaggtgcagaaaagatggtgattataatgattaatcaaggactgaccttggagtttaagccagataggaatgaaatgaggtgtaaggagggagtgaagaacagaagaaaggtgggaggataaacaggtgagttcaactcaatggtactgatgatttcaaaggattgttggactagagagaggaagctggaaagagaggatggagggggtagcaaagaaagagatacttgaaattgagattatggggaatgagaggctgagctagggtataggacagaaccactagaagaaaagaagtcaaggatccaagaggccagattatgggaagaatcatctatgtggatatagcaatcaccaagaattatcacatgactattagtaatggacagagtggcaatgtgccaggaactaaaagatgcaaagaatgagagggagtgaccaaaggatcaggaaacacaaggagcagtatgggtatggcacagtctgatgacatgagattcaaagatgggattttttcagagagaagggagaggtgtctggaagcagcaatgaggatcaaggaggacaatattccccttccaggctcagtggttcaaaagaaagacagaaatcagtcagtacttcagagggctacgggggaagcaatatctttagaggagagacagatctcaaggtgaacaaggaggttggagcagaagatgaggaggtaagggattttgttgataattgaccgtaagtcctggaagccacaattaaataaagatatatatttttgatttagcatgtctcgcactaaatgcatacctactatttcatctagtgctcaaccaaagaaacagcaacctgttttatagatggaagaaaaaccaagtgaacatattgagaaataatttgtctttaatatggtgtcttaaggaattttcacaaataattttgtttatatttaatttttaccataagtggtgatttttgaacttaaacctctacccttcccccacctctccacacatgtagcataaccatatagcaccttgaagtagtatatgctcttagtgtgtaccttgtaaggatcctcaggatctacccaggccacatgaaacatatggcgaatttcttctgccagtccgattcttgctccactgttggctgatacatagatgcgtggaataccttctgccctagcaagttcggaagctctgagaaataacaaatcctcttgaggcccaaaggacccaattcggtatgtgatgtcattgccaataacaatgatatctcggccttctggatattcaggacttttaaaggtcattttccaagctaccatgccaatctggaaaggcataaacaaacaaatgaacagaagtttcttacaggcagaatttttttcaggttcattgaaggtatcagagtatacctaggcacagccattatgtaaagatacacattgctaaagagccaaactccctgtgggaaactacaaaagacattctagtatactgctagattatgctgagaacagctggtctactgtgtatttcaaaactgtctcaattccttctttgggcctgctcaaagaagacagaaaagccaaaatctaaatgcactcaggatacatgtggaagaatgccatggcactgttgattaaatctagatatctcattttactgccatatatactaagacactgatatggtttggatgtctgtcctctctaaatctcatgttgagatatgattcctaacattagaggtggggcctggtgtgaggtgtttgggtcatggggtggatccctcatgaatggcttggtgctcccctttgatctgagtttatgctagatctggttgtttgaaagagtgtggcctcttgtgggtgaaagcaagcatgaagagagtgctatgaacgccttgggcacactacaagagtacaaggtggtgggttgctgcctgcccacccccaaatgccacatgctgcccttctatggtatgcgaatcttgcacctaatcatgtcattgtcaagtcccgtctctggtacttggtatctcagctaaagaagataaggagtcttcagggaaaattgtctactgtaggtaggtgtttgagaaatcccccctgcaggtgaagaaatctggcatctagctgcactacgactcccgtagcagcacctacaacatgtactggatatcaggacttgaccaccatgggtgctgtcatccagtgctagtgagacatgggcacctggcatcacacacaggcccactccacccagatcatgaaggtggagactgcggccagcaagtgctgccagctggcggtcaaacagttccatgactccgagatcaagttcccactgccccatggggtcctgcatggttagcataagccatacttcaccaccaagagtcccaacaccttcttctaggtgcagggccctctcacccaggtgtggcttaaattaactcaaaaatgtcacggtgctaaaaaaaaaaaaaaaaaaaaaaaaaaaaaaaagagtgtagcactttgccccccacctctctcttgctccctctcacctctctcttgctccctctctcaccatgtcatgtgctgggtcccccttcaccttcctccaagatcataagcttcctgagacccttagcagaagcccaacagatgcagttgccatgcttatagagcctgcagaaccatgatccaaaaataaacatcttttctttataaattatccagcctcaggtattcctttatagcaacacaaatggactatcacagacactatttccatcttttgtgacatttgttccaagaaacctttaacacacaaggaagcagaaaaaggatgacgtctcacggactgtacacttttcatgatccaggctccttgtactgtcctctagcatttgataggaataacagaaacactctttactgatttgtttcaggtatgttccatttctgctagaatttaccaatgctcaacattgcatccttgtgagcatctcttgctttcttctagcaccagaaaaaccaaaggatggaaataactaatctcttgctgcactatatgtaaatctctgctctctgttcagcagcatctggccagctacacaaataaatgatattgacttaaaaggcagaggtgacatgtctcttcccaaactctcacagccctctcctgttttaatccccttctatatgagaactagtcaatccttctacttgtatatttgctagttccatttcttttctatgctattcattcatacgctagttacagctgtagtttttcatgtctgcctgcctgtttcccctatacctggataagtaatgttttccattctttttttccccctttctttctgtctctcacccccctccttgcccccaccactcgccaccaaacacaaagcctacctaccagatgagcttccctggtcctgcctaatggagccccagccacatctgcagccttggtccctcatccccaggctgctgcatatcacctcattggggagctggccatcaagaagggccattaacagatgtaaatagcggcatccctggaaagccacatgcatcacccagactcaaccaggccagtgatcataagctctgagtacacattcctcaatccaattgcacatccactgtaatcaggctggttgaagcattctacacagctatttgtgattctcagcattaggaaatatatatatgaaacaccctcagataaatataagctatttaatatatcataccattggccaaatacaagtcaaaatggatatgatacacagaaaaaaatccaatcactttctaagataaggtattactctatctactcattaaagacagagaaaggaaggaaaaatagatcattcaaaaaataacacagtgaacactcaaatatcaggataattttggttgtggtttctaagaagctagttaatataatccctgcatgaggagaaatgctttatctgccttcacacatgcccctctaaccccaaaccttttgtttttcaggaatgaaaagctattttctgtcaattttcctctaaatgcatttgtagttagaaagattgcgttttacaccaaattttatgatatattaaccctaggcacataggccagaagcagcttagatacaagccctgaagaatctacttcagcatttgtgtgctaatgtaaacattgcgaccatgtggcactgggcaggcaaataatactcttatctttcattactacctggggactctaactgtgtcacttgggcagcaagttcagcaattggctaggtcattatgcttgcaatattgacttctaattaggtgtcagcacagcagcaccaagaacacactattctttatcaatgtctttccaaagtatgttgctcatcgaccgcctccccaccccgccccgccccccatcttaaaaagtaccattacagaatggagagtgttatcccagtctcagtgcagcaagattcctgatcagaagacattcagttttgaggtagcatgatggacaaacatctaagaaagcactattattcaatttacattaaaataatttagatttcactgctaatcaaaggatagggcatataaaggtgaacatgggctttggagtccaacaaacttagatccaaatccaggcgctatcacttatattaactaactgtgtgatcttaagaaaattatttaattttactgagcttcaatgtccccacatgcgaaattaagaaaataatacccatgggtttgataaacacactattagaagcagaaatctactatattaacttctacgtaaaaaactttgtctttctctctcctctcctctcactctgtccaaatcttacccattccaaaaggttcatccaaattccatttcctcagtaaagcttctcccagcctaaagtaattcctatcttttctgatctcctactaagacctctgtgtagagaattttttttttttttttttgagacagagtctcgctctgtcacccaggctggagtgtagtggcacaatcttggctcactgcaaccttcaactcctgggctcaaggcaatcctcccatctcagcctcccaaataactgggactacaggcatgtgccaccatactcggccaatttttgcatttttttgtagagacaggattttaccatgttgcccaggctggtctcaaactcctggcctcaagccatcctcctgcctaggcctcccaaattactgggattataggcgtgagccaccttgcccagcctgagaattcttctgataactaattatatgctgcctaggattgcttttggcttaccatcttgaacgattatagcatctcctctagtgcttcccaggaacattaaacatagtctgggagtaataaatgtttgctagttccagagtctttttattttttcaatttaatttttttttttaagacagggtcttgctatgtcacctaggctggagtgcagtggcacaaatacagctcactgaagccttggcctcctgggcttaagtgattctcccattcagcctcctgtgtagctgggaccacaggcgtgtgtgttaccaccatgcccagctaattttttttattttttgtagagatggggtctcaccatcttgcccaggctggtcttgaactcctggactcaagtgatcctcctgtctcggcctcccaaaatgctgggattacaggtgtgagccactgcaccctgcctcacttttaaaaataacacttgaaaaatacttaacaccaagggcttagaacattgccacttatattttaggaatcatagaataagagtcctgaatattcttaaactattttattttaaaaataacaatagctatcataataactaccattaattgaacatttactatctgctgtactgttctaaaagttgacaactactgatagtggttaagagcttaagctgcaaagtcaagctgtcttggttcaaatctcagttttatgctagctgtataaccttggacacttaaccttttacagtttcacttttccaattataaaatggggatgacagcacctttctggaggtattgttgtgagcaacaccatgttaaactagtacagagcctggcacacaaaagccctcaaatggtagtcagtattaattcaaaggtagctgtaattattgccatgaggaaattaaggcacagaggaattaagtaacctgtccttatagctaatgtgaattgtttacttattttttttttgagatggagtcttgctccgtcacccaggctggagtgcagtagcgtgatctcgggtcactacaacctccacctcccgagttcaagcaattctcctgcctcagtttcctgagtagctgggattacaggtgcatgccaccaggcctggctaatttttgcatttttttttttttttttttttttggtacagatggggtttcaccatgttggccaggttggtctcgaactcctgaccttgtgatccgcccgccttggcctcccaaagtgcttattttttaaaaggagtttcacatacacaaaaatggtattttcttttttttttttttttttgagacagagtctcaggccattgcccaggctggagtacagtggcgtgatcttggcttgctgcaacctgtgcctaggttggagtgcagtgatgcaatcttggcttgctgcaacctccgcctctcaggttcaagtgattatcctgcctcagcctcccaagtaactaggattacaggcacgtaacaccacgcccggctaatttttgtatttttagtagagacgggatttcaccatgttggccaggctggtctcgaacccctgacctcaggtgatccacctgcctcggcctcccaaagtgctgggatagcaggcacgagccaccgcgcccagccaagaaatggcattttctttactagagaaattaaggaagtatgttccttaattaaaaagatattagtacaaaaactggcaaaaaaaaaaaaaaaaaagaggtctgtggtttatttaatacaattgtatcaatatttatttcttagtttggtaatcatatcatggttacataaagtgttttaacattaagagaagctgggaaagggtataccagaactctctaatatgatctttgtaactttcctgaaaatctaaaattattttggagggaagtaaattggatagtaagatcactgttagtgttctgtacagccttataagatgatgactatgaagactatgaatagcatttaaaaatacccatgatgtaatactaaattagaaaagggttcagactcaggagccacattctgagactctgaatctgaatctaagataatttgacagaactgagactcagctttctagccatatacgctaaggtaagttatcaacctccctgtacctcagttccttcactggtaaaacaagggtaataaaaatctacggcataagtttgttgtaaggattaaatacatgttaagtcctaggatagtgcctggtatatagtaagtgcatagtatgaatgacaacttcatcaattgaaaagcactttgcggggtaaaaacaaaaataaataagaaacagcaaaatgaggtgataattattgggatgatgaaattgtattttttttccattctccaaattttcttttttgtgtttatattgcattgataactttaactttttataaaataaaaaataactgagaaaagaaaactaccaaatactcttcactgggtgataggtacatgggagtttatattatttatgcctactttagtgtacgtttgagcatttccataacaaaaaaaaaaatttaaggggggaaaaaaatctcaccagcctaattgatttcccatattttagaggaactaattctagattttagtcatactacaaccgatcttatttatataaaatttgaaagagataaatgtatgaaaattaaaaatcaagactcactttaaagagaaagaaatatcaagaactacgttagtttgttgggttatcatttcattttctaaaaagaaatgctctgcaatgatgtggtagagtgtaaacatatgtatatataggtttatacaatattaatgtctctacctcagaagtaactgcttcagtgtttttctggtctgatggttaaatacatatttatatttttaaagtcaatatttgtacaatagacaagaacagtgcctatcagctaaatacatatttaggactgtaccacatgtattacaaacatgtactaaaatcgaaagcttttatttatacagaacctttcatcttgaagagggctaaagaactttacaaacatatgtacataaaaggacgtttgcactgataggcagggaaggtactcattcacccactcccctatttcttctaccagtcctgggtaggaacacatggtgtcaacagatgcaggtctgtaacagctgcaaagacatacaacacaataatccagttgtgatgcacagtcactgagaggaagcttgcaacttgagaatagcaacagctctcctccagtgtagaagcaccatagccatttccagctttgtgtttttaaattattctctacccaactcaactaatcacctgacaaaattgaatttgatactggaaatggtttctgaatgcaaaatactttctgtctgatgatgaaaactagattgaaaaatgcttccctctgcccttgttagatttaggaaaaataaaaaagggttacaacattcaggagaaatggttcaaaatattctacctaagaatagcttcatctcaaaggattagatcattgctttggaagagagtcatatttcactctctaattagtacactgttaagtttttcagtcaaattactttctatagatgggtctatctatattatatacataatggagatttcatatcgaaaattctacaatcactataaaagtatacacagtgtgacaatgtgattagcaatgtgacattcattgatttcacctaagcccaatctgcatgtatattaattgaagaataatgactaacggagaccccatcattaaatccctctttttgggggtcttctctttctctccaacatttttatccaggtgaaacccagtgaaaatgacatgccaggactaagagctgaaggaagatggaagagctaagaaattaacaaaaaggtaccctgtagcccgcatgtaagtgggtgggtttatggtctaatgagttttagactcaaacgggcagtgccagtgtcgtcttctctgatcactgcctctctcatgcactgactaaacaagtggtcctaggtacttactacaaattattttgtcattactatagccatgaataagttttaaaatatttaatttcagatcatttttcataacagaacattccaacgagcaggtttattaggtttagggttatcaacctaagctgattatcttaaagtgaaaaagggaagaggatgaaaagagccacagtgaataagctaaggataagcagaaataaatatttgtttcccttatacaagttctaaggcagaacatatttctttggctacattctgattctggaatgaacagctcaagtgagggaggaggggatgggaaggagaaagcaagcagaagagaacagtcttatttaactgtttttatgtgggtaaaatgatttgtgccacagtatttccataagaagtgggaccattattttcctgtagaaacacatttggtttgaaaagtatcactggacaggacgtgaaaatcaaaccaaatgaattattcacaacctccgatcagaggtgatcattatttctgatgctccaaacagtgattaggattctgccctgagatgtcattttctcgctgagtaacaccagcgatacagaaaggcattatctatctatccatatatgtattttttctgctgggaggaccttggtttaatgttactataacagatagtgaaaacatgataatattaacatttattctgatggtgcccataaatgccattagtctgacacaaagtgtcaacactaatcatgacccaaaattaacaccaaaattgacatcaacattaattgtactatcaatgtgaatagaatgtgcaagcacacacaggcacttcccaaagctgctgttgttactacaaaataaaacaacaatattaagctcaacaaagaaatttgcaggaaaagctaagggcaaaacatgccaggattttgttttttaagggtgaaagacatatccatcaactctagctatgctgtgggaagcagaaagagaatatctttgccacagctgcctttcttacatctccacactttgacttgagctctaacaatacctttccatacagatttaaatacaggttaggctgtggctgagatgttgaagctgtattcgttatattcatgctaaaagccttgctatattcatgctaaaatgatcttgagttttttttggaagagtctgtaaaacctattgttctaattctgctaatgccaggaagatgactaccctgcaaggcccttgagcagcaatacaaagaatccaagcatgttagcgctaacccagacttgggcatcatctgcatcataaagatgagaaaactaagatccagagagcaggaatctgaacttgagtcccttctcagatatataacaaaatgttacctctttcccccttttgtatcttgtatccaagcatgaaaaaaagagtttttcagctcttaagaaaattattttgagctccttcacatgatcacagaacactaaataatagaacattgatatctggcaaataatacaatatggaaaggcattgacatatttttcagcatggcttttccaaatggcacaaattaagtcaaatattgtattttaagccttatggcttacttcaaaaatggctgaacaaactcacctcaacctctctaaacagcgataaaagggtaagaaaaatataacttttagagcaaaaaattttcatcccagaggtaattctttgaaaatgttatcaaagattagaaataacaattttgaacagggaaattatttctccctgtaacatttatatacatgaaaccacagtaattttacacatgtacacacagtaatttaataagcataggaattattttttaacaaacatgcagtggagcacatagaagccagcggtatttgagaaatggggcccaggattaattggttggtatggaaattaaccaagttggcctactatagtcccagaagccttgtccattaatcatacgaatgagtgctgaactctggtgccccccgctactcctcattctctggtgtcatctgttgctgtcctgatgttcattattgcctctggttggagctgtaaagtttcttgacatagggtactatgtcacattctttttcagtaaaatcttacaacttaagacaggtataaatatgctggcaagtacattcttttgtttgaaggctatctctagacttatttttgaaagaaactgaggagccctccacaagtactactttagtgagccagtggatgcattaggattttcaaagtcaatcaaggttactgagcctcattttgctatcaaaaaaatgagtaaaaactactcaacctgatgagaaatctccaacaccaataatagtcattcagaaggaattctgagaaaagtatatacatcccaaaagaacagtgtcagaaattcattagaagtaattccatggtaggaagacttatttttcaaaattagcctccatatttttctaatgagggatccaagtttggtttggaagatcattttagacaaagacttgcagccaaatatacttacttagaatgggaataaaagaacaaaaacatagaattaacataaaattatcttaccatatatgccataatatatctttctctatacttaatctcaaggattcaaaattgatttttcaaagccttgatgaaaaataaggcaagcacaaattatgaatacttatgtataatcataatcatttatggataatcataattatacataatcatatgtatttgacccttttctgctgaggatcccaaagcacttataaacattctcctatctttagggacagattaatggcaaagaccctttttataagttgaacaatcaatgcatagaccatggtcctgttttacagacccgcttcgcttaggtctatttcagaactcaccttcagcatagtacaatttaaatatgcctcttttctaacacatatctaaaagactgacactgactcaatttctatacacagcatgaaaaggcaaactgatttcaaaagaatgaaacaaaagcaaggtaaagtacatccaaattagcatcacattcatggagctattttgaggttaaattgagtaaaacaatttaaaaaatctaatgttaaatatttgggtcctgtgttcatgagaaatggcctacccttttctcaccaccaaaacccgtaagcatatacacactctctacaggcagagttttagaacataatgctttccactagaatctgagtccaggataacccaagcaattcctttgagggtatggaaaatgtcaaccaagtgaattaagacagagggttatggtggtttttctaaaataagaggtcctttgggttaagaggtccagcctaagaactgtcaaaatggatctactaattaatttcttctaatcttttaggcttatataagcttaccaacttcctttccctaccaactcctaaattgtttttttgatactcaaattagagattcaaaggattatagtaacatgtaagtgaggagcccagtcaaaatggtaagatttgtttaagctggtcagtagatgcaggggtatttgtcatatcactgtgtatttttttatatgtttaaaataaaaaaattaatgagatgctatactttgggagacataggatatcagtacattgccaacaattaaaacaataattaaatatgggtattagttgggctagcagttctaaaactgaacccctaatccccactgtccctaccatttcacccctgagaacataaagcaggactaaaaccaaaataccagtcatgatggcagctagtctttttttttttcagccagagtctcactctgtcgcccaggctggagtgcagtcgtgcgatcttggctcgctgcatcctccacctcctgggctcaagagattcctgtgcctcagtctcctgagtagctgggattacaggcgcctgccaacacgcctggctaatttatatatatatatatatatatatatatatatatatatatatatttttttttttttttttttttttttttttttttgtagagatagggttttgccatgttggccaggctggtctcaaactcctggcgtcaagtgatccgccgaccttggtctcccaaagtgttgggattacaggcatgcgccaccgcgcctggctgtcagctagtctttaaactttaatttacactactttatttcctcttcaatcatcctcttctttaaaaaaaaaaaatagatccctaatgcaaggttcaaaggatcttcaaccaaagagttaaaattgcaattgcttattgcaggaacactaggtaaaggctactataccaactgaaaaaagaaggacaccagtgaatctgcctcaacaaacaaggccactcacaaggctcatgtgaatgctaagctgctgagaaggaaaaaccctgacacctagcgcccatctgaaaaaatgaaggctcagagctaccacaattcttaagagtggtagtgtgtgtagaggtgaccatcaaattgcattcaatttttttttctttttctttttctttttttttgagacggagtctcactctgtaaccaggcttgagtgcagtggcgcgatctcggctcactgcaacctctgcctcccgggttcaagcgattctcctgcctcagcctgccaagtagctgggactacaggcacccgccaccacgcctggctaatttttgtatttttagtagagacagggtttcaccatgtgggccaggatggtctcgatctcttgacctcatgatctgcccgcctcagcctcccaaagtgctgggactacaggtatgagccaccacgcctggccccagttgcattcaattttcaatatactttcctcccagaaaaacttttataccaagaattccagtctctgaataccaaccccttttttggatatacatcttgtacctaattattataactgcttccaaatacaacatcgcaacatcgtcttctcatctcagtttctcattatgacaggcatgatgagacagaatgttaaaaagctgcccatgttctgatatagtaagaaaaacagggtcctaatttctactagcactaaagttactatggtagttgactctctaacatatctttcagcattgcccactttagagattactggtctagttcgcagagctgataaaaagaaataaaataaaagaatgctagtaacttatttcagaataaacaagagcatagtctcaagaaggctaggattttctttgtcctaccaggcaaagttaagttgttctctgtcaagtccgttacagcccttggcttgatcttagcctgagctttttaataacaggatttagtgcgaaaagcagctgtactggattgcgaactgttactcaaaatgtccccacctgcaattatagcttccaccaaaagatcaaaacaggttagtaaactggcaggaaaatgaaaacaattcctccaaaattgagaagtggtaaagtagaactgttggatagctgcatttcttctgtatccaggctcaacagcacacattcatctagctgtgtatttacatacagtgcccatcactgtaccaacacagcagctagaaatgagatccgtttagtctatgctgcaatcacattttcctcaattttcatctttacttgaaactattaagaaaaatcttggacaactcatctttggagctatctgcaagtaacgtagttcacagatttagtctacatcttttttattcctactctaaagtcatactaaatgtaatgccattcaaatatgacaatgagaaaaatgtgttctcctatacctttcatcatgcattaggtggtactcctttagttacatctttctttatggggaagggacaactaggaaaatagaaaggagacagtagctaatacagcatcagaaaagctctgtctcctgctctaaacacaggcataaatgttcaaaatgcaggtcacatctctactgaaacagccaatattcctcctcaaatggcaaagaagttacctaaaactaaatggaactgaattggtccaagtcctggtcccatcacctttttacctatttactgtcctggaaaaaaaaattagaaagactggccacccatacagccaatggtctgataagtgcaggttttctgccttcgatcatggagaaaagcacctcaattcatgggaaaactctgaaggaatctctcattttacccttactccttacatccatgtgctagttttcaaactcagaaactccaatccttgaaggtaatgcaataccacccacaatgatgacctggtagagccgtcacttttggagaacaccacattatgatgatttaatgtctacatagcaccaatgcatttacattgagccttggctttcagaacattaacaggtcaattttttattcttttgtaataaaactatttctcaaggctctgtccagatgcccattctctttgggacaggacagatttactccaaatctcatcagcatgagctctgttcattcccttcacatcattcttggggtaatatgtagagtgccaggctcatgacaaacttgctctttggccaaagaaaattaaaccgcaatagctgaaagtcaacttgccctgataaaactgggctcagcacgaggaaatacatcctactgacactttgtcatctcttaggcacagctgtccctcagagttctgactgctgaaactccatccttagattggtcagtctctcagtggacatgctccattgtatgttcaagctattggtagcagagtttgatactaacaccccaacctcattcctgttgtgcagtgccctataatctagctaaggccaatgactgacttcaccagccatcctgggcattagtcactaactgctcacaaaagaacatcagtctaactcctcccaagctcaaaggctcagaaacagcaagctaacactcagcctcaatcctagtcaatcatttgaaaagaaaaacagaacaaagaaaataggcaactaaggagggaaaactgtagaacaagaagaaagtgagaactgacaaaaactcaaaatcttttgaagaaatactattcactttctggtttcaaaactattaaagcactggacaaaggaaaacatgtggctcctatactagatctactactagtcatagctatagtcctatgcaactgtttaagacatatcttttccactaaggtttgttaggtcttaaaggggttaaaaaaaacctttaatttttaaaaaattcgtgtgtgtgtgtgtgtgtgtgtgtgtgtggtctttgggtacagaggcccgtataataagactatttgtattcatactggcagagtaaacactacatgttcatgcccaggcagctctgtgcttgtaatttcagcaagaacagagctctgtccctctgggacttcactattccctgagtctccattcgctcaaacacagaatgagggcagaaagaaagcaggaaagaaagatcatggcaaggggtttcacacagcactgcagctagctttcacgtggccaaaaatctcattttgtgttttaattacattagttaaaaccattttgctctcagccccatgttcacaagggtgccttccattcctgaagactacactgttcaatgaatcagaatttaagtctagcacaatgaagcttttctttgctgctgaggggctcactaggcagatgctacatacagtggcagaaacctctgtttcaacttcgtgtgctgatgagtatatatctatgcttgtcaaaatgttttgcatccttccaccccagtcctcttgactttgctatttgttgagactcctacaagtctgatactctccatctggtccaatgcttgcatccatcttgataccaaatcatctactgttggcatccactggcatattactgaaatagccacacaccttgtatatatagtgaaattttttgaaaaagattgagcaaaatagaaacaaactgcttattatttccaaaggtctacccagcctatttgtggtgaaaacacaggtaaagattactccttcaatggaatgaaatctttctagggattatatttaaggttgaaataaaaatatctctctttttaggtttgttactggtattatcattgttataactgtacattaggagcacagttaaaatcagaaagaatcataatgcatggacaagagtataagagtatagggcaaaataggactttatatcactattcataggttactctgagagaaaggatgccaaggctagaaaatgcattcttgggataattatcaaaaaatgggttctttgctacattttttatgtttgaacccctaattctgattgagccccttcaagaacacatttatcatgctcacaacagcaccagatcaaatgaattgagcatggaaaagacactgaaaaatgcatttattaatatgaatccaaataagaaaaaacattaagcaaaacaatactttaaatgttttcattatagaaaatcctggctgggcacaatggtgcacacctaaaatcccagcacttttcggggctgaggcaggcagattgcttgagctcaggagcttgagaccaacatggtgaaaccccatctcaagaaaaaaatacaaaaattagccaagtgtagtggtgcacacctgtagtaccagctactcaggaggctgaggtgagaggatcacttgagacatggaggtcaaggctgcagtgagctgagattgagccactgcactccagcctgtgtgacagagcgagacaccatctcaaaaaaagaaaaaagaaaaaaagaaaatccccaaatttcacacatagacaaaaacagggaaaataatctattttcatgtacctatcacctagcttcaatgatcaactcacgaccaaccctgtttcatctacacacccaccctcacacctctttatttagaagcaaatcattgcatctgtaaatgtcttagtctgtatctctaaaagaaaacaatattcctttttatttttttaaaactgagtcctttgtgttaaaacaatactattttaaaaagcaaaatcataataccattatcacacctaaaaaattaataatttcttgatactcagtcaatgctctctctaaagaactctcccaacaagactaccatgctccagtgctatttaatgaccacctcacagaaagctggtactagtgggcacagagataagaaagggaaggggggtttcaactacttgcctcatttcctcctggaagcctgttcatgtggaccagctgaccttgatcatccagtaccagttcagtgtaagtcagcatgtcagaaggcagagggggagatggaagaaatgcttgagtggacatagactcccagagtttgatcagggactagtggagaaaagaagtttgactaatcagtcacaataatttcaatatagacaaaaataattattaagattcagtcaatctggttttgccttcttttccaagtgttctgcagagtgtaaacattagactaaattctccagctcccattctcagttaaaatagatttgtaattactttttacatgccaaaagtcaggcacttttccaaaaagtcaaactactgagtgattccaaatcagcaccagagcattaacaaacaggaaagacctaacactatcctaggaatattaaaattaaaaaactaaataagtagcatcgactccttaaaacaaagaaaaggaaaatcctaaagaaacttgacaacaaaggaatatccaggaaaatgacatgacgctcagctaataaaaagaaaatccaagaaggccagaatgaagcttctactagaaattccagggaagaaacctctttctaatatttttcatagctataggaccatacacaggaattagctcactagatgtgtgtgactatttgtaaatgtgcagatcaattctgctcaattttgacacagacataccaattcatttaaaaaatattatgatttccatttccaacttcctgtaagtaaatcctttgtgaagtgggagctaattcagctctttctttgcttgcctcaaagcaacatttgaatcccaagtgactcatacatacctatgtgtcctaatcactgtgtttatgcctattatataggaagaattacttagaatgtgatttatattatatttatatagaatgtgatttatattatatttatagcactggcattgggaaacagaagtaacactcagcttttaggctagcaatgctataaaagggaaataccgaatgaaggtatctttcaggagacagaacttgtaaacaaatggttgcataaaggtaatctcttgtatttgtgaataacacaggaattctacacagactatttactacgactacatatattactttactaaaattcaaatgtggtaatactggtagtattgactaggagacttggaaaaatcctatattcatagatttttttaaaaaggacaaattcagtattcttttgataccttattctttactggttgcattttctactggtgatacacttttcttgccttctattgatagaagaaaaatctgcagcatagagatgattcaccatacagattgaaagaatttgttttcatatagaggctgagattcataatgtcatattttctcatgctagtttttattcagctataacaaatctcccacaaaagaacttatactctaaactgtgtaccatgaactctatatccatttgtctatgctatctatattgattctcatcatattaatctagggtatcaactaggaaccaggtttatattggaaaatgagaactaaagtatcagatctcctttttaatatccataatttgaatatagacttgggaaatacacaggtaactcttcacacaagtcactgtaaactatcaccacaagaacataaccttagtttactctctcctgtctcctactcaatagagacttctattctcaccattcctctcattaattcataaagaaccatccaatatctgagttggcagtcaccaatcctcaaatgaaatagaaatgaaaacagtgtcaagatatttcttgccctttggagtgcccccttctagccaaaaccgcatctgatggaaattcagggaaaccttgcctccttagaacatgtcagaccctccagttaggcatcttacctgccgaaacatctctgggatatcatatatgtatgttgtccctaaggattgtgcctggaacctctttgattgcagcaggtctttggtcacatatggagtattgattaacattccatgcagtggtccctgtttgtctccatatgcctgaaacatgatctgcaggaaaaaaaaatggcatggggagttaagagacagaaaaaaatcagagagctgcctagaggggctttttttgcacaaatattatctctttgaaaacatttttggtaggttgagtagctgagatatgcctcttaacactgggtacttggtgctctcacctctccacagattaaccaactccaaaaaatatatatatataaccagccatataccataactgctctcacttttagattagttgaaatcaacaagaaagaaggccaggcgcagtggctcacgcctgtaatcccagcactttgggaggccaaggcgggaggatcatgaggtcaggagatcgagaccatcctggctaacatggtgaaaccttgtctctactgaaaatacaaaaacattagctgggcgtggtggtgggcacctgtagtcccagctactcgggaggctgaggcaggagaatggcgtgaacccaggaggtggagcttgcagtgagccaagattgcgccactgcactccagcctgggcgacagagcaagactctgtatccaaaaaaaaaaaaaaaaaaaaaaaaaaaaaggaaataaacaagaaagcacggtgcacatttcgcatctcaaagacagactgaccatgctagccatctaaagtgagttgaatctcatatactcagaaatgaagtacatcaactaaccagtctgagcagccctggtattgaagttgaagaacagctatgcagtaaagataattctcttctttcctcaatggcagaaggccagatcaagactctagtatatcatctgtgctttagtcctttaacccacttgattagatggtacttcataagtattactagctatgcaaaggcttcaaagatttctgccagaagtggatttcatccatccatctagatagttaattctcactagcccatgagacacagcctcatattttacatatagtaaaataaccatattatattaaattatgtatattaaaaaacatatatatatatatacatgtatttacttctcctcaagatgctgtctacaactagtgaatagctcctgcaatacctatattgtcacataatgaaatcactacactggtttttaatcattttaactcaaatatttctagaggagtgcttcatactccatatatttagatagttttatttgcttatgaatatttataaaggatgccattatttcaattcaattaatatttattgagtgcccagaggttgtataacactaaactaggcacttcatgcatggatacataaaatataaattcccagtgcagtgaatacaaatggagattgggatgtaagggtatgtgtatacctacatatctattcagacctacaaaataagcacaagtctaccattaatgaatagattgtggacctgatatatatgcacaggaatagaattaagtaccttcctaaatcgtgggtacagttcatctgtaaatccttagccccttagctcagaggaatgaatgttctgctaatttgtcaatcaggtcctgttctggggaaaacatgtctcaggctgttttaaagacccagagattggagctcccagtcctcttccacaagatcaataggaaaagtcacccggggggaagcagaattagtaatgtcttaggaatgtgtcagtaaaagcaataatgttttaagagattcaaagtgttaagtaaggcaagggtacagtatgagaaaactgtactcagagcaagtaagctgaatcaaaataagaaaatggggtaaacgcagcaggttcctagaactacatttctcgtctgttaagagagacaagaccttgagactcggtttggccaagctttgtgatgaagacaggctggtcatagttaagcaacataattgtgcactgaggaaggggattggagaaaacaatctagctacatatgtatattgctggcagaaatttaaatggtacaaatattttggcagtttgtcaatatcttataaagttaagcatatgcttactgtgtcccagcaattacacttttacgtatttacccaaaggaaataaaaatatatctacacaaagatttgtaaatgaatgttcacagcagctttattactactaatagctcaaactaggaaataaaaccccaaatgtccatcaacaggttatcttggaaaattagacaatgagaactagagggccgggcgcagtggctcacgcctgcaatcccagcactttgggaggccaaagcaggcagatcacgaggtcaggagatcgagaccatcctggctaacacggtgaaaccccgtctctactaaaaatacaaaaaaaaggctgaggcaggagaatggtgtgaacccaggaggtagaacttgcagtgttgcagtgagccgagatcgtgctactgcactccagcctgggcgtcagagtgagactccatctcaaaaggaaaaaaaaaaaagaaagaaagaaaagaaaatgagaactagagtttcagtccttttttttttttttttttttggagacggagtttcactcttgttgcccaggctggagtgcaatggtgcgatctcggctcaccacaacctctgcctcctgggttcaagtaattctcctgtctcagcctcccgagtagctgggattacaggcatgcgccaccacgcccagctaattttgtatttttagtagagatggagtttctccatattggtcagactggtctcaaactcctaacctcagctgatttgcccacctcggcctcccaaagtgctgggattacaggtgtgagccaccatgcccagccagtcttttttaatatccataatttgaatatggacttaggaaatatacatgtaactcctcacacaaatcgttgtaaactatcatcacaagcatgtggtcttagtttactctctcctactcaatagagacttctattctcatcattcctcccattaattcataaagaaccatctaatatctgagttggcagtcacccatccccaaatgaaatagaaatgaaaacagtgtcaagatattgcctgccctttgggggtgccccttgctagtcaaagctatatctgatggaaactctggaaagccttgtttccttggaacatgtcagagctcccagttagtcaccttacctgccaaaacatatctgtgaatataaacattttgataaatgaatgtaaaaatttcgataaatccattaaatggggctgggcatggcagcttacacctgtaatcccagcactttgggaggccaaggtgggagggtcccatgaatccaggagtttgagacaagcctgggcaacattgtgggaccctgtctctaaaaaaatttaaaaactagctgggcatggtggtagacgcctttagtcccagctacttaggaggctgaggtggaaggactgcttgagccaaggaggtcgaggctgtggtcagctatgattacaatattgcactctagcttgggcaagatagtgagaccctgtctcaaaaaaaaaaaaaaaaatccatgaaacggaatactatccaaaaatgaaaaggaacatacacataatctatgcaacatggctgaacctcaaaaacattatgctgagtaaaataagctagacacaaaatagtacacactgtttgatttaaattctaggataggcaaaactaatctatagtaacagaaagcagatcagtggttgcctaaggccggggttggtgcttctacctttgactgcaaaggcgaataagagaactttctgcagtgatgtatctaccacaactgtgatagtacttacacggtgtatacatttgacagaatgaattgaactgcacacacaaaacgagtccattttattataagtaaattgcacttcaataaaggtgttatttattatttttagaggcagtgtctcactctctcgcccaggctggagtgtggtgtcacaatcatagctcattgcagcctcaaactctggggcccaagtgatacttctgcctcagcctcctgagtagttggtactacaggtgcatgacaccatgcctggctatttctttttttttttttttttttttttttttttggtagagacagggtcttgccttgttgagctggctagtgtcaaactcctgggctcatgtgatcctcccaccttggtctcccaaagtgctgggattacaggtatgagccaccatgcccagcccaaagatgattttaaaatgttatttttcttttttttgagacggattcttgctccattgcccaggttagagcacagtggcacgatctcagctcactacaacctccgcctcccgggttctagcaattctcctgtctcagcctcctgagtagctgggactacaggcccctgccaccactcccggctaatttttgtatttttagtagagacaggctttcaccttgttggtcaggctggtctcgaactcctgacctcaggtgatccatctgccttggcctcccaaagtgctgggattacaggcgtgagtcactgcgcccagcctaaaatgttatttttctcttacactgcacattggaaatcaattcacttatgcaatggattacccaaatctcttctccccattatgactgcctgacatcagtgttcattacagcctatactacaaagactgtacaaggaaaatgaaaaataaaactcaagccaatcaaccttgttccttattggcagaatgaataaatgatgtgctagggcaagaggctgatagtaataggagttcctgaatactcaactatctatgttagttccattttctactataatgaacgcagtaactaaaaactgtaaagtatgttttagaagttcatgaaaatatgtacacattttatatatcacacacctttcaccagaagccatcaaaattattttagaaaataatttctgacccatagtctgctcccttagaacactgtatttatttataatagcacatatttgccacagagaaacaaatcatttgtcttcttccattgtgatgtaaatttcttgagtacagtttgctttttctctttatacgcatagtgcctgacatactataagtagtcaatcaatattaaattaaaaaacaaatgaacgaataacagacatggttctgtattaacttcatacaatgattcattaaagaaagggaaaaacagtttgacaataagcaccatgtaggcattaggagcaccagaactgggttggaggctgctccttttgtcagttcccacgtctagccacaggctcaaaagttagttcccatatggcagtagctcttgaactctctcaagtgaagagtctgtagaagacctcttccttcagggcttttaaaatatgcaggaccctaggtaaaaagcgttttccttcaggctgaaggtggtttgttcattctttcagatgcttattgtgtgcttattttgtaccatgtgtaatactaaaccctgattgaaggcatctgtgcctttcacactcctgtgtcaccattagctagcatgagggaaatctcagagtttcctaataaaggaaaggaaaaaaaaaaaaagaaagaaagtagttatgaagaacaaacatatttatcaaaaacattaaaatctcaagtggccatcttacttttcacaagaatagacctgccttgaagctattgtagaagttaattaaaaacatccctacccattgaaagctttgactgaaaatgtctttaaagttgcactaaaaaaacatcaaatacagcaaaaaatattgaacactctttctcttggtcaccactcacgctcttgcgcactctctctctctgtttttaactgctcacttctcataggatagatttctctagccacctcactaggaatcaaagcacaaaatgaaaggtcattctgactactgtccaaactgagatttttaaaaattcatcttcaaaagactgaaaaatatattttcctgactctattcctggatttaaaaggatatagataaaaacaagagacacataatctctccctggcacccaaagcacggaatagactgaaacccttgtttatgtatactggagcaggttcatcctttaatcagaagaaatgcaattcttgaattcaggccaaagccataaaatatcctagttcttcaaaaatgtgaacaatggtgaaccaacctaatttcagtatcatagtaaagagcccaaatatttagaaaccaacgtagtaaaaaagattaaaagggaattctctgtttcacagaattagtgtactgactcactttctatttttacattctcagttttcctacctgaaaacgggtttaaatttgccactttgctcttgtataatatatgacaccctgaaatctttgaaggaaagggaacaacataatagataacacaataaatatgataaaaacagaaacagaacacaatagataaatatgatagacactgatgatggtagtgctcatgccactatactatgttgaaattttccttctttaacatagaagttggtgacataaatccaacaattctcttttcctcacttgccaatgagtagtttaattatggtgaaaacggaaaggacgcatcagaccagagattagattgctgaaataacccacgagccctctaaaaaaagagcctaaattgcagaataacctctggagtcaggttcacttggcatctgttagtgcttaccaatacatgacaaatggttaagggttttataacatccatgatagagaacataggcaaatcttataaggcagatgaagtttttcaaattcatacaatcatttaatcttatagaggataatcccaccaggtgaaccaatgggatttgtgagtgtgggtcttctataacaaggacgagtgtcttatctgtaggaccaaatcaaaactctgaggagcctgtttgagtattgtacctgtgctgtcctggagtcagtcacttccttgtataggctgatatccaagtaatagccagactcgtttgtcaggaagaggcggatgggaattgcttttccagttggcgtcaggcgaatgttgattttcagttctgcctggaggacgcgcaatttccacaggcgacttccataccgcattaccatgctccgcacggattcctcaatctgacacagacacatcaccaagcacaaaacttaaatatcttctaactaagacctgtttcaggtctgctcatatttgagaaagaaggggtaaaaaaaaaaagaggttggtttgtggagatgcacaccttacaaaaagtggtcagatagtttctccccaaactattctttcttggaacaagtcagggacaatttcatgctggcctggcatttgagtggttttctctcgataataacacccaaatctctgcaactccttcccctttcccaattatattcatattctatatcaaagatctgcagtatctaaaattacaagccatgggatttaagaggaagccccaaataagaataaaatctctagttaaatagctattaagtagcatttatatgcatggtaactatgtttcactgcacttacaggactttaaatcaacacagcaattaccaccatgagctttttttcatacagttttattaaactttataatatatgtctcttggtaaattgcacaaattaaagaaaggcaatttgtaggtggtgctagaacattctctctaaacagagctctgaagcttggccactgctaagtccacctaggatttaataagatggggcagatgttcccacatttctctaagtttataccaaggcagcttaatgctcttagtttttaggggtaggacagttattttaactaaatggccttagacatgatttcttgttatttacatgctaaagcaaaactttttttccccaacatggctgcacagaacataatgcagctagaacatgctattcgaacttaatgtatccttaaatgaagtatctttctaaaatgcttcctcaacttcttagaaaatctcaagaatatcttacattccctttctcttgtggttctttagtagcatgtgccacccttgcagtttgtttctgcaccacaaaattttaagttagaatgaatttcagggagttaacctctctattatcatacttgcttgttaaccaagagatatttacccattcttttcttgagggaacaaaagccaacaatctttatgtacagaaaattggcagctatctatcattagaaaagcagagccagtgtatatgggtggttagaatgaaagcagaggctgatctgaaaaactcagagaaaaggtaagccaaatctaaaaaaaaatacagctgtacagtgtccatgccatgttttaagtttcccagcttattagtcccagaatgcttaggagaagttttgcttaaactagatgatgagatttgagtcaaatgagtagccctgtccttggcgttccttacaaactaaagcaacccatcattagcttggaatttttaagggaaaaaggtagaaaactacttctcagatctcagatactaagttcaagaagcaaaagtctaccaggcatgatgactcatgcctgtaatcccagcactttgggagtctgaggcaggaggatcgcttgaggccaggagttcaagactagcctgggcaacatagcaagaccctgtttctgtaagaaaaaaaagaaaaagaaaaaaaaaaaaagcagcagcagcagcaaaaattcatgcctacagctgatcttgaaaaagggagatactggttctcctatccaaattccacagtatcatgatagaaagagttagaaggggccaggcacggtggctcacacctgtaatcccagcactttgggaggctgaggcaggcagattacttgaggtcaggagttggagaccagcctgactaacatggtgaaaccccgtttctactaaaaatacaaaaattagccgggcgtggtggcacatgcctatagtccctgctactcggggaggctgaagcatgacagtctcttgaacctgggaggtggaggttgcaatgagctgagatggtgccactgcttcagcctgggcaacagagcaagactctgtctcaacaaaaaaaaaaagaaagaaagaaagcgttagagggagcagaaacagagagcagcctgtctttattacacttgggataaaaggtcaagtacaaaatcaccttgtttttcttccttaaattatatagaatgcatttcagaatagaacctcagggaagaaaatatacataatacatgagaaattccttatcagccaaattctctccctgtggaaaaacactaaagagagataggttagacactttgagaaggtgcattatctcactaaggccaccaggtgattaacatttagtgcacagaagcagtaatttagccaaaatgcttagtaacagtaaaattaataattccagatgagaaatagtagggaataatacaaaacaggaccactattatggcaaatataaaataggtaccaacaaaagaaaatgttttcacgtttttgtactgcttataagtgaccagcaagctaacaccaaaaccttcagttttgagaactgttttttcaatggctatatcaaatttttgacactgtcccagaaactcaatcttataaacattctataaactttacagattaagggctcaacagcctgaacaaggagtacctgtttccaagtccaagtgagataaatatgaatgaacttctgtgcttatgcttgctagtgctgggagagaagctaaggagaaatgtacctttgatgggtccatgataaccgtgggcacaaagttgaggaagatgtggttacagtcagtgcggacatttgtattgttaaaagcaacttccaactcatccatggcttccaggagtagccgctccccttcattttgcagatattcaaaagaagcttcctatacaggaagaaaataatcaacattaatgtagtttaaaagaggcaataaagaaatggctattataatcacttaagcagcagtatatcatgaatcataaggcacttggtgaagagattgtttatctttctccctagagtcagtccagtaaccacagggagcaggggcaggaaagggccagataaagagtccatgtcagcccttcctccttacttttagtgcatcattcccttccaagaggtagaaatactgggcatccccatagctgtaagttcaataggatgatatttcacatatgccaaacagagctatttagaaaggaaaagctgaagaaagggtacggctatgggatataataataatgaacacatcaggaagtgccttgctatatacagacactacccatacttctagacaggtgtacaatgggatcacctctttcctaacttatctccttatgctctaccatcacccaattcttcctgtgatttttctgtttgtatgctttttcttttcttgagtgttattatgcttctgctaccaagaaaaatcaaattaaagtggaaaaagagccttcattttttattttttttcagatgcactttctgctttgtaaaaaaaaaaaagcctttattatatgaaatatttacttttgtaaacattgaaatagaacaagaaccttgattcaaaaaatgaaaacctgatcttttttttatgttctctctcagcagaagcataatacctaattttgaatcatatctattattctgtcccttccctcagggataacatcccattaaagtacagcacccaccttggtgaccagatcagaatgcctgatgattgcacgaacaaagaacctgtagtctgtcacttctgtgcccacttccaccttggctgccccgagatacaggtgcatcttgtgattagcacatggaatggcagtgaggtcaaaatttctcatccggttcagctctaactggaaagccagagcaggctccagatgacgatagatacgatcctcctcaaactgagtacaagaatcagagaaaaaacagttcacaagaggcagttacaaaattatactatgaatgtgaatgtaaaagagatgcctgaaaatagaaacataagctatgatgtgctaatgagcaacaaaaatgagctacattcaaggctaatgctacagcttacataagattaggcactaaagtacctattatataggtactttataggatgatattcctaaactttcatcatttatgattttacaagtggtgatgatatacatgaaaaacaaacaaaaaatcctcaatttccttagaactcctacaacatttaatgtctttatataattcatttttatattaattacaggctgcttcacattaatatctacttcacatgccaatgttttgagcttacccaactaatctaaaaattttctcacttatgataagtacaaaggacataataaatactcaacaaagaaacatcatacaattttttaattaaagagatatttggctttggaacactatatccatagatatataattacttatatatgttttttaaaagttgtattagtatataactttactgtatttactgtatatgtactgtatgtttcagtgaaactaaagtatttttctggaatacatgtcaattgagtgaatggagagagagagtcaaatatataagccggtaacaggaagaaagcaacatggtctgaagttttgtattttaaaattgaaaaacaaattcacataaagtagagttgagtatcagtgaactatttgtagataacaagaatggtcctttaatatcacatcattaggatcattctacaggacaaggatgatttggaaaggtatcaccttcgttgagtagctcaatacatttggttgtttcccaaaccaaaccctttcagaaaggaatcggctttagttctaagacacacgtaaggcaacaggaagcacaagttcaataagagaaaaaagaatggcaagaagaacgtatggcaaagataagccgctcttgggcttttaagaaaaagtaatttttttttttaaataggaaagaaatcaatccttaccttatcccttgctcggaatgtaaaaaatttagggaattctctctgtattaaagaagggggaaaaatgtgtcagtagttcatagacatggctctttgagaacaaacagtatagaaacagttaagcatttagaagccagttttctagaaaaacatgcttcttacctaagcttagtccaggaaatatatatgaatgatcctccgcataaccatcactttgaccccatttccaaatttgagaatcaccacattataaacctaattttagtatctaccctctcccaggggaaaaaaaatgtatgaattttttaaatctcccaagtgaaaaaaatttttttgctaggtattgctcttggcacaacccagcaaataaaaccaatatacccttgtgccacagtcactgcaatagtagttaatggactgatttcccaagttactctttaagaaactcttaaaatataaactactcagacagtatagagtgctcagtccatgattttcacatttattctcaagtcaataatgtcaagggtttaaatgataacatttgaagatgaagaaaaatataagattctaccttggtcactaccactatatgtataggaaagaataaggttagaactagtgaacttgtaatcattaggtcttcctgcttttttgtagggcattatacaaaaaaaaacccaatttactagaaccttattaattaacaaagatgaattcaattagcagagttcattagtttctgaaatttaacttaccaatgccaaatacccctgtttctcggatgggaagctctactggcagtgctggaatcaaatcattactatttgcctctataggaggtttcattaggcatcttcttcattatgagtgcaatataatcaaacacttatcagtacaaggcagagagaccgggactagctgcctacacatcctcaatgagctttaggaaatgtgaaggaaacatggactgaaaatcttctggtggcaggtactctcatgtgttgtcctatctgatgctctcaacaacctctaggggtagatattgtgaccctcatcttgcagaagccttggctcaagtatatgctcagaatcacagagctggaagataaacttgggtctctctagtgccagagcccatgccctctgatctctcaagggcagagtattacctttctctttttattataatctaaattcctcatttagaggatttctctttgatgagacaaaaacacagaaattaagactttaaatttaaaaagcagaaagcaaacaaagcaaaactcatgctgtaaacctgtggttcttgaatttcctgaaaatttcttgaatacgttccataagtgttacacctcactctcaccttaactaaagcttgcacagttaataaatctttttatcttttccttggtattttaactgtaagactgcatttaaaaggttcctaggagctcatttaccaacctcagggaaatccttttttaaaagcctttttaaagtggattttacacaggactgaacttctcctcaagttttgttctaaataattctctgacaccgcccccacccgttatgagagtgaagcacataggactgacttcaaggttaagtaagatgcattcagctgaggtgtcgataaatatcatgctcatggttttatataacctagttttggttttattctagtgaggtacagctttcagagcattacctaaaaagtaacaaatgtcaaaaaaggaagaatgacaaaatctttccatggaactctctgaaagaaaagtcaaggaaagtgataatatgatattttacgcacacacttttctattccgccttaactattattagctaattaattaaaatgtttgtttaggatgccatttatttaattatgtacatttataggatcaaaaccatttcctttcaaaaacaaaacagtaataaaaaatgctttcttttccactaaaccaattaagaaaatttgtagtaactgaaaggcatataaagcagtttgaatggaaatgcctttaatacaaataatgaagaaactgactaattcttggcagaggtgggcaatgactaccaattagaaaaaccactttcattaaggttagctaagaaaagttgtcatgagatcatataaacaactttttttttttaaacttctgagtaaatttgtaactccccggtaaaatcctcaatttaagtattaaacattcagaacaagagatggcaagaacctctgtgcaatggaaaagtggaactactaagcaattcttcagtgacatggaagtctgaagactcttacaaaaagtaatctcttttggcactcaaaaaccacagaatcacagaaaacacagaaaagaagaaatctaaaagtctgatcctacagttttagtaaattcttttatcctatctcatcctcatactgccagtttttccactgaaagcattcatgcttattccatcatcaatgtatttgctttccaagtattctactagtgtcatgggcgaatatcataattgaatgtacacaaagaaaaaccctcttagtattctggtaccaaaaaacaaaagaatgcaacgtttcacaggaagaaattatgcccttgctgtgttctaatcagccaaccatcatcaagacaatcaaaataatttgcccaaattagccaatcaagacaccccgcaaatcagagaatgtgaaaacctgcaacaaaaaacatcatagctgattatgatactaataatcgtgttaaaaacctaatgagatgaagaaattgggagcttgctggtacaattctcttttacctcaacatgctgagaactaattatatagactgtaattaaaacaaaaatccaaaccaacccttctgaaaactaatagttggtccactaccaaacagaactatcttaaaaaaaaaaagaaaaaaagaactactaattatgataactgctcatatagtgagctcttccttcaaggtccaaataatccaaaacatttcattttaaagtgggaatcacacaatagtcataaaacaacaactctctctcgggagatatgtagatcttttttttaaatctcatgaaattttacaagaacaaaaggtaacattttattaacagatgtaaaactgtttgatttagaatcttatcatggttttaggacttaatgggggataagaagaagtcctgaaaatttgtattccgatgtccttagccaaactttgctgaaaaaaatatggaaagcttaaaaaaaaaaaagcataatattatatcccaattagacagcactttctgctaaatattttggaattccagacctaaaatgtgagtgaaactaagacagagtgagtcaataagttttaactaacagaaaactgtggagttgcagtttagatagctgcagaaattcaagaagcctcttttccattcaagactttgatcttttttcttttttttaacatcttgtccatttttttcttttattttttattttcagatgaacatcatgatctactttattttttcttaacaagtagaatatatttacaaaaagagacttgtttttcctcaaagtttctgtttaaatatcaaagttaggcagttattcaaattccattatgggcacttgatttaattagatggttatggaaacagagtcaactcccagcctccttaacactggtgaagactgctgtcacagaaataatctccatgcagtgtcaacggactagggtggcaacagacaccctaaaaatgttttaaagctgtgggcagctatctgggacaactgtggctaaactacgaagtattgtaaatgcttatagcaatcactgtcatccaaatcagtacctaacaatatacacagctctctagcaacctctactctggccctcatttgtcttattctggttctgaggcaatttgaaagaccaacaactatataacagcacagcttgctttattccactaaccaatgtgcttgaatcaaacttggtaaacttcctcctctccttgctccctcaagtgcaaattctctcttccattcaataatatagggattccacagcattggacaggggaggctgcatacatcacagtggattatcaagaagccagagagatcaagggattcatctctgacactcccagaaagcttcctctttttcacagtacactaactatggggcaagcacaatcagatgacatgacagaggctaaataagcatccttcatgaatgtcaagctaccatcagcaaaagaactcacagcagcaccacgacagtgacccccagatttgtacagtttctgccaacgcttcctggctagtgtagatcctggattgtataatagattctggatggagttcggtttaatagttgcccttgcaccttgcaaaatcacttatcatttttaaagggactaacataaaaacaccccaactcctctgccattcaattcttcagagcaaatgcagtcctcacttaaaccttaatgttctctatgctctaaagcagcttttcctacactcatgacaaatcaagtcacttgataatttaagtgatttcccacttgatgccactatatataggaatcagacaatgattgtcacggaagaccccctgctggcctcattttctagccgattttgcctatacatgtccctattaaacctagatccagaaatatcaggacagcagagagaaaaaaatgttttaaagctgttaagtatactcttaatactagggcatatttataactatacactatagattcagagataagaaagggtttttttatgtgttacatatatgagaaaatgtcagtgagaactaatcactttggtttgctaaaaattttagtgaacagttttagttgatcagtgtatttattatagaaaccagttagtgtgctatagatgtgaagattccatctaatccattagcaaaaaggaaaacaattttacaaatttagtgttattccctagaatatgctgttattctaaagtcggtgataaaaagcacagtaacatttaagaacctagcacaatactcttctaaaatccagggcctggctctggcatgtctaccttagttctgatcagcatctaccagccacagtgtttatccatgggctttcatattctatcccaaagtatcaattttattctctaagctcctgatttttcttcctaaagccctagggttctttttaagctcctcatacttctccactgactccgtttcctatctaaagttattgattgacatatatctacactctgcttgatttcctgacatcaataacacaggggagtcatgcagtccacaacatttcctaaagcatttcagaaaatcttagctctcttgtttctctatagactagaccaacaaggtgaactgtatgaaggaaaacaaaatgtcaagtcttgaaaacctaataaacaaaaaggtaataaaagcaatcacacataggtccttgagtttagaaagtcctttccagaatctcaagtgccatcttcattgttgcaaacaagcaaggcttaacaaccaaattatcttaattgctaaaaccaaaccaaacaggctgggcacagtggctcatgcctgtaatctcagcactttgggaggctgaggcgggcagatcacctgaggtcaggagttcgagaccagcctggctaacatggtgaacccctgtctctactaaaaatacaaaaatcagctgggtgtggtggcacatgcctgcaatcccagctacttgggaggctgaggcaggagaattgctgcaacccaggaggcggaggttgcagtgagctgagattgcgccactgcactccagcctgggcgactaagcaagacactctctcaaaaaaaaaaaaaagaaagaaaagaaaaaaaagacttcttaacatcctctagaatcttagttagctacattagaatcaatttttatgaaatattttgattataatcagtcattttgaaaacaacatattgattccaaactggatttctggccttactgttgtcactgtactgggtatgatcatacgggtataccatagtttggatgccaggctattaacttaattctcttttcaataaaaattttaatctcataaatattaacagttaattcagttaaatgggagaataagcaacagagtgtttaatttttacttatttcctgttcctacgattaacataagacaaaaaatagcaacttggctctatcaaggcattttaaataataaatcattgttctttagaattgagacttctcaataaagaatccaagaccacaaaatgcaactggctgtccttgattattgattcactataagcacagaagaaattactagttagcttgtttctaccttatttatctggataaatgcttatgttcattcttaactatttctcagagatatattgagaattcattatagggttaaaaaaaaaaaaagaagaaaacctttagctggaacacttgatataagaattaaaaaaaatttttttttaattaatagaggactgggtctcattatgttgcccaggctcatctcaaacttgtgggctcaagcaattttcctgactcagcctcccaaagtgctgggattacagagaactgaatatttattataataatttctaaaagaagaaggatcaaatatcagtccagcccttctaacatatattctggttaaataatcagtggcagacaaataaaacagtaagtaatctttcattattgttcattttacttacatgaaatctccgatccacctcatagttgacctgctttctgaaatcctttcaaataaaagagagaaaggaaggaaagacagcagaagttggcaattagtaacaaaatcaaaaagaaattgagtaaaagatgatgagttaaactaatgttttttaaaaatgaaacttacagaaaagtggttatttctctgcataaatcctattagtaagcataagattacaatcccatttttattaagttgtagcagcagcataagaaatattaaagaggtacaattcacatgtcagtaccttttgtgcaaccaggaaagtaaggcgccggatcccatggtcaaccagggtagctttctaggagcaaaaacatgtaaaacagaagatagatgagatttccattcattctaaattttatcccattcggcccttgtaaggctttggtggagttaaacatcctttttggatatccttatcttagcttagtaccttcaaacttgcaagtgaacaaatttcaatctggctcctaggactaagtcttacgaaataaattttatattgatttggacaaaactgaaagagaactttgtggaggagaaagggtgatatgaagtcaactaaattacctcagaactgatttacataaaggtaggccatgacacaatttctgcttatagaaatcatactgttgggcatgtattcaaatgtaaacattaatattgataaagatgctaaatgaaattaggtagagagaaaagaaggactttccataaaacataaaacacaggtcctaaactgtttagattgtagatgttacctaccatcagatacagcatccctagaattcagtctaacaaattgtaacctttcagttttgatacaacagtccccccttaccttacatgaaggcattttttaaaaactctctcttttaaaattgttaaaagcaatatttaataggcctttaaatttaggaactattcatatctccactaggcataggcgactagtatattagaagtcaacagaaggctgggagtggtggctcacgcctgtaatcccaacactttgtggggccaagatgggcagatcacttgaggccgggagtttgagaccagcctggccaacatggcaaaaccctgtctctactaaaaatagaaaaaaatgagccaagtgtggtggcacattcctgtaatcccagctacttgagagaatgaggcatgaaaatcgtttgaaccaaggaggcagaggttgccgagattgcatcactgtactccagcctgggtgacagaatgagactgtctcaaaaaaaaaaaaagaagtcaacagacaccagtagtttcaagacagccacttatacgagtcttgggcatctggacctaaagccttcctcttccctatactgttcacttgcttcaaaaggcagggacaaagaaacaaattaatgaattaagtaaaagacatgtgtttagaggtccccaacaaagaaggattataacagcaagcagaaaagcaaccccaccagttgaatgacctgagaaaacatatgaatagtacaaatagaaaagtaatgtggactttcacagcctacatccagactttagtttgaccacatttcttgctataactccaaccaagagatatgtttataggccagttcttaacattcatgatattatatattttttaaaatttaaattgtcttccccttataaggaagcacattcttgggttatttcttccaatttcttcaattctgcgatggcattgctgagtaataaaattaattttattaacagcataaacaaaagataactggaaaaattaattttctataagcaaataataaaataataaattatcaggccaaatataaataaattttggtttaactgcattaaaaaattatttgtactgccatcacacaccttgctgtaaataaccaagtattgacacaacaatatgaaaaaaatgtgtcgaaggaaaggaggggtttctcagtgtggccaggaacagaaatacttcttctgacatcaacaaagattccactacagtcaagtccttcaaagacaagcatcagtagctatgttctggcaagggaagaaaataactttaataatgccatgatttaaaatcaaaattgttattgcttttaaaattccacaagtggctgacaataacagcagagcaacaggattctgattacattgtaataatgcaggtctcacagcaagtccacagctattacccagcgattaggcatcagcacctggagaaactccatttacactgactgcttcaatctcctccacaagtcatttacaaatatatgatcctaatttctatgagagaaaaaaagacatgctgggactagaagattatttggacaatttggatcaacctatttgatagtttaatgtgtgccttaaaaaaaaaaactttttctaaactgctaggagcatgatcatgaagtgaaaaacaaaactagttgccactttatcttttgtttttttcttaaattgcttttctttccttttctttcatatatatatatatatatatacacatatattttaacaaggagatgaaaatgccaaatgtccctggataagcacagtacctgatgcagtaaatagcttctctatgcttagagtgtcagcacagtctacccttacctttctaaatagccttaggcaaagatattggatttctctgtgccttagtttccacacctagtcaaggaaaagggtaatttcttatttctcattaatgttacaaacatatgtagcgaatatgaagaaaatgcttttttttttttttttaattgagatggagtcttgttctgtcgccaggctggagtgcagtggtgcaatctcggctcacagcaacctccgcccccaggttcaagcgattctcttgccttagccacccgagtagctggcgctacaggcgcccgccaccacacctggctaatttttgtattttcagtagagacggggtttcaccatattggccaggctggtcttgaactcctgaccttgtgatctgcccgccttggcctcccaaagtgttgggattacaggcgtgagccactgcgcctggctgaaaatgtctttgtagatcaacatgcgttgataagtatgacacttagatttgagggcaacaagaagtgtcaagttgtggtcaaattatggaaaaatactcaaacatgggcaattagtgcctcaaaacctaggaagaaactttcacagattatttcatgaagcagcagcagcagcagccacatataatattaagactcttccaggccgggcgcagtggctcacgcttgtaatcccagcactttgggaggccgaggcaggcagatcacctgaggttgggagtttaagaccagcctgaccaacatgcagaaaccccatctctactaaaatacaaaaattagccgggtgtggtggcgcatgtctgtaatcccagctactcaggagtctgaggcaggagaatcacttgaacccaggaggcgggggttgctgtgagctgagatcgcaccattgcactccagcctgggcaacaagagtgaaactccatctcaaaaaaacaaaacaaaacaaaacaaaacaaaaaaactcttccagcaaagattaccttgatcactggctttaggttaattttatgtggtcactggccaagggcaagaaggaaggtaaatttctgtctacagaaaaagccctaggcatatcccctactttcacttctctggaagcaccttttcctcatactgaccactgcaatctcatagttagtttaagtgctacaacaccgtcatggaataagtactaagactcatagtcatcacaaatttaccattttttcccctagatatctaccattggcattacatgatgtgaatgccaatggtacgaactgtctacaccactgaattaaattttgaaaacatctactgagttctttctctgcaagaagtccatgggctaagtgctgtccactccaagagaacacatgggtcttgccatcaagggcagtttaagaggacactttgctatctatcacatatcataatgaaatataactgtagattattgttttaagcatgcctatcctgtcccctcaactagactataagcatcttcagggctaagaatgtattatttactaaagtacctagatctgtgccccctatacctggcatcaaatccttaagttctagtatttgctctatcatcttctagctggtgacctaggggtcttaatttctctgagctccagcttttgcccatgtgtacaactggaacaattcctgacttatctaaccccatggaatcgtggtaagatgcaaataaaaaatttaggtagaatttttttataaataaaaggcattattattgctaataaatgtatgctgaccaattaggaattcaaaggaggaacatacattttagttagggctactcagaagtcctcactgaagagatgaaatttgagacagttcttaagacaaacaagatttagaaagaaaggtgaaagaaaactttctaggaaagaggaagtcaaagaagtataataaatgaggcacattagacaatgaacacaggtcttttcacaaaatagcaaaggctacatgttagtctctcaataggctgatgatgttgaagctaaagttaaggaggtattctgaaggtcagagagaatcactgttaagtgggaaaataacatggtaagagcacatttgggacatttaattttgtggtgatgagcagaatggaaactctttggagggagaaagtgaaggaagataagtagatcacaagtaagcctgctgcagtgtctcaggtataagatagtaagggtttgaattagagatggcagtgggaattttaaaactggaaagaagaaaaagagaaagggtaaaaaagactgcaaagaaaaactaacagaccttggtgactgaccagatacaaataaatatgtacagattgtgggtagaggggtagaatgaaggaatgtcaaggaaaaagtcaatgacttttgaatgattgggagtaaaaggtatagtgagttgtgaggttttttgttttgttttatgaggggattggagagggacgagaagaggtgaagcaaaatgatggaaaatgtccatttagacgatggcgtttgatgtcaacaggagatatccaagtgacgtaaaattgaaaggaggatagatgtataactgatagtttcaaaggaggggaggggaagacacagaagggacctaaggggagtttaggcttagacatgtggaaagtcaccaaaggaaaatacttggtaggtgattcgaagttcaagactggagctctgggagagatttaggaagataacttcccttaaaaacattttaaatatttgaggtctattatctgttgacacacaaagatattcattatatattattaagtcactttgggattttatccctaaacgcagaactagccatagttctgagagttatgataaaagacatagccataaactagcaactgataaaaggatagctatgatacacagccagtagaaaggggacatcacgagcttccacccaatcaagaacttacattttgctgggtaaattctctgaacatagctgccagcctgtcatcctcaatatcacagtcagtcttgatagccacattgagaatgtgaattggttcatccctgggaacctgtaactcaagaacacaagtcaaagaaattatgaggctggccaatacagatgcagatagaagttataatatttggtagaatacctgaaaaagagatacaccccacaggatattttggtttgcccagcagtaggaatgagcaaattgaaaccactgcccaatagccacagagagattaaatcaggtaaagcatataaattttaaaagataaggcagcagaggcattagtaacaggtggcccaatctttacttggcatgaagctgaagatcactatgtctcaccttttttaccaataaaatgggggtgaaactatttgccacatctcttcacagaatgtgaaggaaaatgagtgatataagccatctggacatgttcccacataatatatttccttacaatttatcaaacaatggaagtatcaaatcatgaaaaaataacatcatagagaaagaataatttatttactgataaataaaaagaaatgatttaataaaaagacaaagttttcaacaaaatgcctactttttttctgtaatctaaagtcctccattctctgaggactatgattgcaccactatgcaaaaatataagccatggctgagtaagaattccagcaaccaaagcccaaatccttaaaacaacattcagagattcagaggcagctgcaatggacatagctgagcccactctatactatggactccaaaattaatatagtttttttaagttaggatttatattccacttgtttccagaaaatactttggtgaggcatacaaaattaaatactataaagtggggtaaaaggatgaattctttcctataatagttcaaagtcagaaagatagtatacagtagaagtcccatgtctgaggggaacaaagcagtctcccaaaagggacattataccttatcctcatcataaagagacgtgtgacctgcctcagggaatgtgggactctggggtggggagtcagagaagcagcccatcacttcatcaaagatcctaaaaaatacaagagaaacacccaccatgaaaactcaagtggcatgaaactaacactgccattggcagctgagtctaaaagaataatctatcttagcctgggctcaatagttaattgaacagaatcaccagtggctagaggtgacatgcaaaatttcaccaagtggcagaaattaggaggatggattgtttaaactttaataaaccatatatattttttcttttttagaaagaatgatctaaagcttttttgtttgttttgttttcctcatatgtaagatatgagcacttctgtcatcatcggtcttaaagtaacagaaagtgtctggaactggagtagtgacagaccaatgtaattacccctccccctagggtaatgcatcagtatacatcaagagatagatgctgaatgcatttaatcaaaagatgtattgtctcttgtggggctcactctagtgttatgtttaatttctcctgacatttcactcatcacagagcagacagcttcttctgttagctccacaggaaaagatggtttttgtttgtttctttttttctgaccaggcccatactacaagtagaggcttgtagaatctgaatgagaggtagaaatgcaaggatatatacctctccaacggcatatacagcaagggttacatctttttagctggctcatggctattcgggagacctttattcattttgcagaaagatgagaccccaaaacacagatgtccatggctccccttgtacagacatagttccacaatgtcttacctgacaaaatcttcaaaagtccgaaaagagaccattccgcccatccgctgacaaggtggagtgaatgagttgtccaacagtacatcgctgacactagctacatgggtcatgccatagtggttgaggttggaggagaaggacattctaaatggtaattcaatcacgttcattagacaaggagggtaggagcaaggactgggaaagtaacagtagggaaaaggaactaggagaaaactctgaagtagggtcaggttgcagagcagatttggtttttttacccactatggataaggttgttttgctggattcatgttaaccctttcttttgaatttccctaaataaactatattttcatcactccaaaatttcttcaaataaaaagctaagaactgttaggaatttccaggcagttttaacacaattacattataagatgtccaatgaatgaatagcacataggggttaaaaaccatcctgcatcttccccctccctaaagcattccctcctttaaaaggaagtaagcaagccaagtgagttgtaactatgcaatgcttaaggcattttgttttctaggaactgtaatagagtaagtattcacagatacataaagagataggtatatatatgtatgtaaaacaacaattgtaattaagtcacctggaatggtttagtaaataattatataaaacattagggtacagaaacaggtcacagtctataaaaggaactttactgaggaatttactttctcctttaatgggttggtaggcatagttattggggttacagttctccctttttgaaagagagctatttttcaaccccaaattgcacgtttttcttttcatagttaagcacttctataccaaaacaaaaaaatctccattgaaagcccttaataatttccagcaagatacaaaagggcagagcatgggtctcaaagtatgtgtaagcatgacaagcagctgctaaacggagatgcctgaagagaactgaactgatttgctcaatctaaaaacaatgaatctctatatttcttgatgtaccttaacagtatgtactgataaataatactgtaaagtgtttctgaatgctcaatcaggacagcctgttaggaaggaccaagctaaaggatgcctccaggacttgcctgacatgttaccagcatactgatctgaagcaagttcagggcaaggcaatggcacttgaatttggggaactgccccaaaaatctccttgaagtacaccacctgcggtgttgcagggggaagagagacgacaacgtggacttgatatctgggtacatattgtaccctatcgcaaatcataattacaaggcaatggaattctttgtaggatgggagtgctgctcacacagactatagagactgacactccaggtttttattcctttggcgagtgatgactatggaaaaggtacatcatcttttgacagtacttgggagtagaaggcaaagtgggagaggaaaccattgatacaatgaatgaaacaaacaaatgaaacacacatcaagcaagtcttacacatggtgctcactagaaactgggattcagagttgtattaccacagaagtgctatcatcctcctcttttctaggatcaccaaatatatttactaaaaaagcaagtttgtgaggcattgtatcttttctacttgcttggcattagacaggaaagataaaagggttccagaccacatttaaagggaactccctctgaagaagttaacaaactatgtttgtggcaaccatggggttaagtagctttttcactcaactgaaccccatgggaaatatcgactattcagtttcccctcactgctatgcttgtgaaccagggtggctaaaggcaggcaggaatgagccaagcccactcaccaagggaagactacaagaccaattaaaagcattccctttcctctccacatccaaattgggatctaaaagctatgattagtcttgattacttaatattttaaagggagagggacaaaataaatgtaaatctataaatagttccacgtgtagctgattatctgcaaagaccttgccatcaacttactattgcttttgcattttgtggattcaattccaatcagaattgttatcctctcaaacttgcattgtgttgccttgcttggttcaagagacaggagaaacccaaaatactaaaatatcacttatgttatattagcctggaaacctccacacagggttaaacacatcaaaacttaaatatacttttccaatgttaatcttattataggtctgaaataaaaactgactatcataacattttaacactttagaaaattaactaacaaactgataaaacatgagatcagctatttctggatctgcactcctctaaaaggagaagcaaattagagaaactaaaaattgtaaaaactgtgaataatttgccaggataggagtaaccttaagggtttctcctctgaaagccccaaactacacagagaacttagcaaaagaagatgttgctagcaaggccggacataaggcagataaaccccctatcatatacagctagatgggagcttctccatactgaggcttttcaagtagtgctttttgaacagctgaagaaaagctgaagccatgttttccaaacagaaagaataatttagtatgtccaaaggggagctcaggactccctagcagataacacattatcttgtcaagtgttgtggttttttttttcctggtttcactattctaagttacataaaggtgcttttaattggaaaagaaactaaacatacggtacctgtttagcgtagggatgttccctctgtaattaaacaaccacagttagttactgataagttagtgaaagccataataaaagaattgtcagagcagatatagaccagtcatgaggagctccagtttggcagctctggcattcagcagacataattaagtgctcattacccttcaacccccaggatacctccaaagaggcatgctcctaacctacctcaccacaccagctgttgatggaaagggtcaaaatgtatttaccatggattttaaaaatagctctattaccaaaaaaaaaaaaaaaaaaaaaaaaatttagagtagtggtaaaacacaggctgatgaaaattaatttaagctatatgatatggtatattaactcaagcttcaataagaaatataattcttcacaggattcttagagactcttctttcttgttcctattactgaaggtgtaataaggaggtccagggaagttgattccacagctcctcctactttaatcgcttatccaggatatgtgacagacctacaaattctccaccaaagaaaagtatccaggaatctgggttcccagctacctgctctaagtctttttaaccatactcttcctcccatgaaggagagcaggggggaaggtactgtattctaggagcttaaaagaactgaaaatcatgcaggaaagtaatgataaatgattctatgataagttgttaaaattaattaatactttgtaattaaatgagtttagggtcataatgattttaaaaattgctgttagcttaaaaactctaggcctctcataaataaaaccttatctaaatttgactaccacagaacttccttataaagaatgtgccaaatcatgaaagaaagaccacgataagaataggaaactacaaggcacatctcccacattctctttggcctttgccactaactccttttaaaagatttccccaactgaaaaataatcaaacaaataaaaacctttattttcaatgttaaatgggcaaagttatacttaccacctacaatttaggggcattgtaagggggctgatcggttgatatcttaaccttctaacattcttttatcagcatttaatcactgttggggttttctagcacacagaggacttaatgggcagaacatagtgggtggtgctgatgatatgtggaaaggaagatagagggaggaaaacgatgcactttccatggcagtagaaggagcagaatagactgagcaggccatataaataaaaagctgtgacatatcactgcacacaaactgtatacctcatgtgatttgtgagtagaaatgctctttgcatcaaacctgtatcacagagtgaattcataagacagcaagagcaacctctgagtgcagaaacctgaacctttgctgtttggattccttaagcctctcactcaggagagtgggttttatttttacaagagatccttagttataatgcacttgggcctcaacaatacagaaaaaataggcacaggttctagaacagagggaggtacagctgaacagaaaactaactgcagatgctaatgagaatagttttccttttacgatataaaggatgctaaagaaaggggccgcctgcacagtttcttagcatgaatctcagttcagagagaactctacaaccaaagaaacctcaggttccattcatccaggtttctagagtttagaaaccagtataatctctctcaactgttaacaaatttcctaatctaataaaataatctaactgcttctgtagctacattctaatccctttgggagtcttcacaggatgacggccatgttttcagtagaaaaaggcccgaactgaaaagaacaccaataacaacaaaaagccaggctttctccatcagcaactctcaagctcctacagagagccccctgctgctttgttataagaattatgcaccatctacacagtatgggtcaaaaagcaaaaactcccaacatctctaatttttaaaggaatggtcccaaatcaatcatgtaagtaggtttagagccagcttatccacttaggtagaataagaatctgtggggatgtaagggagataagcaaggaaggaaggaaggataaactgtctattaacagataaatatttggtcatgtccataatgatcatttacatgttttctttttttttttctttttctttttttaagaaatagagacaaggtcccactatgttgcccaggctagtcttgaactcctgagctcaagtgatcctcctatctcagcctcccaaagtgctaggattataggcatgagccagcaaacctggccactacaaatttttcatcctatacaagggctatatggtcaatttaagaatatgacaaatgtggcatatcgcacactactgtgatacaccagaaagctagattaacactctgtaccaaaaaaaaaaaaaagccacacacacaactaagggaagagattgtatacgagtcaaatattccatttatgtagctgaaaataaaatttgccacattccactgcatactcatcacgcaaaaatagtcaaattaggccgggcgcagtggctcatgcctataattccagcgctttgggagactgaggtgggtggatcacttgagcccaggagtttaagaccagcccaggcaacatctccaaaatccatctttacacacacacacacacacatacacacacacacgcacacaaatataaaagttagccaggtgtggtggcacacagtacacctgtaatcctagctactccgaaggttgaggtggaaggatcgcttgagccaggaggctgaggttgcagtgagccaagatcatgccactgtactccagcctgggtgacaaagtaagtctcaaaaaaaaaaaaaaaaaaaaagtaaaattgctcaatctttgataaggcaatcaagtatattttcaaatacataaatgggacataaattcacttcctatctgctgtttgggctattcaaaacacttattataatgaatcttcatttacaacatttgatgaatattagaaccactttctttctagtagattagctccattttacagatgtgataaccaaaaaaccaaagaggatgctttccaatgacattgttcaatatggtgtcataaaccacaatctagacttggcattttcttatctccgctctccaagttagcattccacatcagtatagattttagagaaagacaagagaaatcctgtgaattctgaggttcccggcactaagtcacctctgattttattgctctgcctgcccagaatggctggagagcttgcttcaatatgaatgcaaagtcagagttgccgcctgctagctgaaccctctttaatttaaagaacactgacttctctggcagccacaagttctgtgagcctttttaccatcccttccagctgaatttcatttggcttgattctagctggccttatataaatcttttatcatataaaaatgctcctgattcttttgcttcctaacttgaagaagaaaaaaaaaagagcccatatgaaaatgatggggatgcatgcaaacaagcagtggttacatcaagctgtgactgaaagccagtatagggcaactcttttgaaatcaggcagcaaagcagaatcagaagaggtcggctgaataacctactagcagccactaacagcagtaccataggagaaagagcaatttgactggctgtgaccagtggtggtctctttgcatgactatatttctgcaggaaaatccaaatcaagaactgtaaaacacatctgaaccacgtatttctactggcatctcccccaccacctccttgcagttcagatgccctgagtctactgcagagctttagtttacaataaaatgatcattacttcattcatttgcagcccctccaaagccccttctttgctctgctggaaggttttgctctttctgaaacaagtacatcaacagagctacagcatattactgttgcctgctatataattagctacgaacccacagcacaaaactacggggatttacaggtgtcctggattctgcttttccttcccccaggactcagctagtcttccttgacaagaagggaccttgggctaccctaatgatatattgagagttttaaactcaactctccaatcttacaagtctagagtgccaaaataacacagcagagactagaagctgagccacggatacaggaaagcactttggtaagcacttaaacctgctgagaatcttctcttctgccagatacttgcatcttatcagcagactaccctgaatgaaggaagcaagcactgtaagatttcatttatttatagctcattctggcttgctaactacaacaagtgctcccactgcagaaacaatgctacaagttggatgacttctgagtatctcagtactatccaaagaaaggtctaatctctgggtgttaaagattatcagaattcttgagaatggcagttggctaccaattagtcacatggaaggctcctgatttctaaccttccttatgaataaaaagtccagaggccgcccactgacagctgaacattgaggatggatgccaagcagcctaaactcagccatgaccaaaacacatgctatcaggggaaaacacagccgacctcttctggaggtaagacttgagaaaagggaagtatttgaattaaaacattataacacagaaggccaaattcacaagtagcaaacagcagagaaggtacagtggaatccgacttaactaaagcatggatttccatctatgaaataggtggaaataaacaccaataggtcctcacccattatatatgtacagaaacgtacaacaaagtacacctccatctcctgcatcaaatgtgatgcttcttatttgaatcacagagtaaaggttaaaaagattactcatgttcactagcgtatattaattataaaaatcatttggagttttaaattgtgtactcccagactgtcatattatattatacagagtcatatgtataggcacaatttatgggataatatactttacatatgtttgtataaatataactatattttaaaagatcaaatactagttgactgaagaatttgtttccagattatcctgaggcacttaatatgcccaaagcttagtgaaatcctgaaggtcaaatgagtcaatgaattgtgcaaaatacagacattcaggatgatgcttcagtgtaacaagctttcccatcaccagcaccagtgagtgatacttaagtttctgaataggaaaaaagacagacatatacaaaacttgggctctaaaccctaagactcactagggaaagaaggagaaaaaggaatattcaatgatatagtttgaactccagggttaattcatgtaaaactcactaaagggctgggctcacagaatcttcaatgagagaattaggttctagaagtctgcacaataataaaatgctcccttagtatagactagttgccctgaatattcctgcaccatgaaaacaacttgagatagtcacttctccttcaagaacacaagtcagttaaaaaatgacacattaaaaaaaaaaaatcccctcccctcaaaaagaatcacacagcctttaatgctaagaaggtaaaaaaggaaacacacacacacacacacacacacacacaccccatacacgttacatatacatacacacacatgtgtgtgtgtgtgtgtgtgtgtgtatatatatatatatatatgtttctaactatgcttaaatcagaaaaatctctttagctgctgttcaagtgaaggaaattttagaagtaaagggtaaatccagaccagaagcttgcctgagtgaagttctaataactggatcctctgctgaataagacctacagatgccaaataagttggaactacagtccccagaaaaaaaatttagaagtcttgggtagaagatcaaaaaggagataatatacctcgactgatgcacacctagcaagaaatgaaataggaagtcacacagattaggaataaactatttagtaatctgctttttaaaaaaattattggagtttttttttctaaaaatagtcgaattataccaaaaaacagagtaaccgcaacatgtcaaacaatgcaaagtcctatgatgaattaaaagaaaaacaaaaatgtaccaaatatgttactacaaagcaactgttcaagtgtgctaaaaacaggtgtcttctcccttttcagaggctcccctagtcatttgcaatatattttgcctacttctctaaaaatcaaaataggtcctaataagtaagatacaggtcttcaatcccaacagcaactaagggattttcctgaataaaaaaaaaaacaaaaacaaaaacaaaaaaaactctgctgccagtttgcagacagagtgccgtgtttcaccccaacctatggaggctaaatcacagtcaaaaacaaactgcgtgactgggaattatagtaagaggagttaaaaacaagggcaggtgcagtggctcacgctcgtaatcccagcactttgggaggccgaggcaggtagatcacctgagttagggtgttggagacagcctgaccaacacggagaaaccccgtctttactaaaaaatcaaaattagtggggtgtggtggtgtacgcctgtaatcccagctaatcgggaggctgaggcaggagaatcgcttgaacctggaaggcagaggttgtgttgagccaagatagcaccactgcactccagcctgggcaacaagagcaaactctatctcaaaaaaaaaaaaaaaaaaaaaaaagctgcaggaatggaattccatacacaatgagattgcagtcttgctttgatattacagcttactaagacacttctaacgatgtgctggacaaattttgtctacttcaaaaacacctagctaggaatgtgaagaccaagtgcaaggaaagaaaacacaaaaaattggttaaacaaaatactgtggctcatgcctgtaatcccagcactttgggaggccgaggtagacggatcacaaggtaatgagatcgagaccatcctggctaacacggtgaaaccccgtctctattaaaaatacaaaaaattagccgggcatcatggcaggcacctgtagtcccagctactcgggaggctgaggcaggataatcgcttgaacccaggaggcagagcttgcagtgagcccagatcgcgccactgcactccagcctgggcgacagagtgagactccatctcaaaaaaaaaaaaaaaaaacaaacaaaaaaaaaaacctgttttctcccccaataatttttggtctgtactaggtatggtggcacatgcctgtagtcccagctacttgagaggctgaagcaggagaattatttgagaccagcctgggaacatgacaagaccccatctctatgggaggggaaaaaaaaattggtttgttaacctcaattgggaaaaatataaaattctgttttatattgataagtaaaatatgtatgattcatataccttttctttattctcactgatttttaaagcatgcataaaatattgtagtgtaacatctataatatcaactgtgaataattcctgtaactactaagaataagcaacataagaataataatttttcctctctccacgggcactaccagtaacacaaaaaaaaaaaaaaaaaaagagggctcagtgtgactgtcctaattaatttttggtctaagttgaactgtctaatatagcagccattagccacatgcagctagggtagtacttgaaatacggctagtttatattgagatatgctgtaagtatagaatacgtgctaaatttcaaagatacagtatgaataaaagaaaaaatattaacaattgttattacatattgaaatggtattttggatataatgggttaaataagatgttatttgaattaattttatctgtttctttttacttttaaatgtggccaatagaaaattttaaatagcatgtagcttgtattatatttctatttgacagtactggtttagaagtagtaactgtcaattatagctgttcatcagagttcagaggagcttttcaaagtggtcacctggactctaatccaaaatgaatcgggtcttgaaagtcaggactccaatatgtgtattttcaaattacccctcagataattttgagaatcattaatctagaggttagtggacataactgagccttacaggacagagtggaacaaatattggtagccctctgtaacttctttctgtagaatgagaaacaatatgcttttcgcctgcttgatcaaaacaataacatacaaaaaaagtactggagttagaaaaagaagaaaagtacttggctcaaaactagctaaatctaaaagagcttagatttctgtttaagatgagcaggcctattgtataataaagactttggccattgtctctggttcctggaagagagactaaatccttataatttcccaagtaataggagtgtcattgttattttaagtcccttggatcacacctgagtttatgctaagagatgagatgactcaggaggggagctggtcactagaaagaccaactgtgtgattagaaggttgagggctttcagccagccagacctctgggaggggagattgagtttaatcacgtaggctatgatttaatcaagcatgcctacgtaatgaagccctgattttaaaatactctggacactgaaggtcaatggagcttcttggttggtgaacacatggatgtgctgagagggttgataaactctgattccacagggaacaaactgggaagctctgtgtttgagaccatcccacacttcaccctaagcgtctcgtgcttttggctgatcctgacaataaaactgtagtgcttgaactctgtgagttgttctgagggaattatcaaactgagaaaattgaggggaccctcaaatttgtagccagttggtcagaagtgcaagtggccaggggaccccacttatggccccatctgaagtagggacaatttggtggtggactgagcccttagcctgtggcatctgatctaacttcagatggctagtgtcagaattcaattgcagtacaccagctggtgtcataataaggttataaatccaaattttaacaaaaacatttgggggaaaaatatattttatatatataaaaaacatatttttcatatatattatatatataaaaaacacatttttcatatattataatatattatgtatataatcttataaaactaaattcaagtagtaaatctgcaataactgaacaagctatactctgaaactgaatacatcattttatgatcaaacctgatcatttgatcctaaacagaactttagatcaaaaaaaaaattaaagaaattttaacatttttctggttttcacaaagatgattttatttttcctttttattttgcaattatcttcaccttcacagttataccaataataatgatgacaataacaataataatccagcaggtttagaattacactgacaaccaagggagacttcagggagattacaggattactgttatgttcaagtctgatctttatctacaggcatgtccagatgttgggagggactggcatataagttttgtaaccacattgaactaaccaagattcatactcttgacatagaaaggtgaataagatttcttaacaaagcagtcaagaagaatttctctcatttttcagccaacattccctcaccaaactggacatatcctcaaataaaaaaaagtaggacagggagaacaattaagagagacaaggagagtgatgaggagggaaggaaatcagaagcagccctgcagcctgactacaaatcactgcccaaagggaagcaggaaaaagcaggaagaaaaggagaactgccctgagaattacaaagagcattaagtacagcgtgtagttctctacaattattcaaggaatgcaggaaaagaaagaagactgagtgctgtgcctatgtgtgccatgagtacttcgccgctcactgaaggacaaccattcgtttctagaaaatgagattctgaaatccatggaggcaaaaatgtaccgagagatgcttgctaaatcaaggatatatgcttttctctgccagccataaggtatttttgaggtagagaagtgaaaggatattctgagacaaagaagagaggtactttttctgaagatgcctctgctcatctgccgacctctgctggatcaacagtggcatccagtggccaaaagtctcagcacagacttctttgtctccagaaagggtttctattgctttgggtgaagtggcaatttagaacaaaaccatttctggtgtctataactaaggttcccaaaagacacagtactttgtaataccaagtgaagaaccaaaggccataaagaagaaatggagaggggcaggttaagattggctgtggtatttatatttcctgtggtattactaaaaagaatgaaagtacaggaggggatgaacctatgtgtgggtggaattcctagattttcattgccttagaatactttttaaaagatagtctataagataaagtattttcattttaaaacaaaagcaattctgaaacaaaaacgtccatatgtacattttattttttaaaagacaggaagggacaaataatgtaattatcatggcttaattcagtaatttatttgagattaagaagtttggttctgcaatgtaatttttaaaaactgattgaatttcaactgctaaattcaggtggtctgttttagggagataatgaaactggctcagatataacctcaacccatagcaaacatatagaaaagaaaagcattccacccaaagtatttttttggtctaattgctgatttaaattgttaaaaagagtgatttttctggcaaagttctagcaagtaaaatgctagtaaattctttctaattttttaaaaaagaaagaaactatttcctcagtgacataatacaagcaagaatgaatggagtaatcctaaactttcatcttacttagaccataatttttctctttagatcaaagaagtgggcaccaaaaggctcttctcttttggttcatattgttcattttttgccctacatttctaactaaaaaaacatggaattgtcatacacattactccccttgattctcatggtatacctctggctggctcgggtgcacataccacctcaaactcacctgtttggatgagatgtgggcagcatgaactggaattccaccacacaggtgttgtccttaagctggcggtgttgtacgctgttaagttcataggcaatataagcccttcgaacatacacctggttcaaaagaaaccctcagtaaataaatttcaaaaacagaaattaagaaaatagcccagaaaaagagtcttgaaacgaggtatctgaggcagaaggtgctctgtggggagagaagtcccaaggccctatgtatacgtacatatattgctttaattaataaagctggagtcttaatactataaccatgactactaatgaaaacaaaactaggctgcctctgctggacacctatgtgcactgtaaaccttcttccacactaacctaaaccctggagaaggtttaatctttagcaaaagacagcatatagaactacaactattaatctattaagcatgatcatttcaacagaagattaagcagtgagaaaaatgagaggtgctgattttgagccacttacagagtgaaaatagaagacacaagcaatcacagtacagttcaactcttttactatctcatgtctttgtcttgcgtcctccccgacttccccacccgctcaaaatcagttttcagcaaactctgatcaaaagcagtaaggcataagcagtaagacataatttgacatataatatctcaaatacttgaacttgactcaagagttaaaggaacagcaatgaaataaaataaaaataaatataaattaaaaaaagaaacagcaataggctacatctctgcaaaaactgtcagtccaacctcacacatttcacagcaaatttgccatgcacataaaatgctacctgagattctatggcacgggaagtatataaggaagcttctcattaaatgacataaaaacactacaaaacacttaaatgttttaaaacttttggcatttactgagtaggataatttacactctaccacagagtacaaataaaaagtaacacaaaagagctggcaacagactaccgtgatgttacattacataaaatcatctaaaacactctttttccccatcttcaaaaaacaactatttggcaactttacagtggtattcagggcctgcaatttttgtgcttaatgaggtagtgtgctgtagcggaaacagaagtctttggagtcagattagcctgagttcaaatgcaaactcttccacttattatctatgtgattttggacaaatcacttaacctctcagagtctcactttcttcttacttcctaaagtaactgtaggattaaatgagaaagataaaatacctaaaacacagttcattaaatgctattactttctttcctttgaggaagtatttcataagagctgcttgacaatccaaacataactaaaatcaattttaatttggcccaaatcacacaatggtaagatgacacatgctctgatcagccatatattttcgctttttgtgttacaaggaatcctaattcattatgaaatgggagaattcaaatacctggaaaatagaaactactgaaaaatgctggcagctattttcctgtgattggaacctagaagctggtgatgagttcagatgaaacacttgagtaaagtatctgagtaagcacatactgtttcagaggaaaagagactaactacccttaagaaccaaccttaaggccagagaactagaactgacatggcagccaaatagacagaagaaaccagctagaaacaaaggaaaaggtcatgtcccattaccataaatacttacctccagagctgccatcctcactacttggttgctgtgatagaagaagtttggtaggacatcaaaaatagatgtttctgataggatgagtttctagaagatacaaagacaggcttaagccttacatcaaaaggagaacaatttcaatggacactatttggcatttgaagcatttagtgaaacctaagaattttgtctctgaatgccataatctctctgtgcctcagcttcctgagctacaaaatggagaaaataaaatacctatcctcatagggctgttgtattatatgagtaaatacatgtaaaattcttggaatactgaattaacaatgcattatttgtatgctaatataagtgtttatgactgttattcttttctgacatttatctgaactctctaaatattgtcttcaccaggcatggtggctcacgcctataatcccagcactttaggaggccaaggcgggcagatcacttgaggtcaggagttcgagaccagcctggccaacatggcgaaaccctgtctctgttaaaaatacaaaaattagccaggcgtggtagtgagtgcctgtaatcccagctactctggaggccaaggcacaagaatcgcttgaactcaggaggtggaggctgcagtgagccgagattatgccactgcactccagcctgggcaacagagtgagactctgtctcagaaaaattaaataaaataaatattgtctcaatactccactatggtaaaccctagatttgaactccagttgaaaccctagatttcagctattaaccaaataagaaaaaacatccttttttcccctctagattccccaggaagaaatgttacagaaagtctaaagattcccctgggccagatataacaatggtatccttgtttccaggtagaaaaatataaagtcattcctgagaagataacatttaaaaaataattgcggtggtccttctgattagtagtaaaattagacaataatctcttaaaaacgggcttcttataaagcttaataataagcattaacataaaattaaaattaaatgatacttaaatagctttgtctccagaagagtaacaactacctatgtatacatctgattcaaatatcataaatcatcagagaaatgtgtgtgtgtatatatatatatatatcagaaatcaaccagccttgtcatttaattctggcctagaatactttctaggtaaagtacaaagataaagacttcaataggacacttctatcaaggcaggcctatttgatttttaagctaaaccacaattctaacagcatttgtatgaaaaaaatattcataagtataaatcattttagaaagtcaagatatgaaactccattatatggaaaatcaaaattaattaattaagtgactaattacttaaactatgcttgagaataaaggaggtaagagtccagataggcaggaaagggttatatatatatatatatatatatacctgcaggttctcaatgcaaaattgatgtccatacatgtcaatagctgataggaagatagactctacttggttatggcgaagctcatatgatggcaaatgggaggcaataagaacctagagtgagaacaaaataggaggcacacattcctcggagtgattattctagactcctattaggcagctctgatacaaaagcaataaatataaatctgtaagtgcaggcatcacagataaaacagagaccaagtaaaacaacttctaggtcctgtaacataaagccagtgccaccaaatactgaatctcagttgactctcaccatgatttgcattgtggccaatttcccatggtgggtagggggaagggagagaaaacagcttcgatcaagttccatcagtgtatgtgatttaccattgcaaagctgctggtcctagggactgcatgactagctgttaattgggaatcaggtctggcagggagcagctgtgggaaaggtagatgcagcagagctagccttttacaactctgaagtagaaagaaagactagggaaagctgctttgacagccccaggtactcggcaccaaggagaacgcgtcaggaagtaacaccagagtgtgtgaggggcagagagagtgaaagcagtgtcacaaacaaacaaacagtgacacggtaggatctgaataccctcagcaggtcactgagaggttcaatagctttgagtagttcagtgacatggatacaattgtagagaaagcagaaggtcactgaacagcttcaaatgctgcttccttgtcaatgcccatgcactgaaacacaaagggagtgccaactcttggcttccctgctgaaaccttttggaatggaaatgaagactgcagggtgaaactaactggacttctctggggttgttctgattgctgccgcctaagattcatttcattatctttctgctttccacacttgattatttcctgtacacttggaagttttcatctgcttctaagctccctttgggaagtaagaaatactgagtctattttcttccctgagtgtcctttcctccacctgaccctggtttactatcacagggctactagggagggaagggaatgataccaggattttttaatggggaaagggcttctattttaaagagacgcagcactaatcttttcctttctctttaaaaaaacataccacatgaaaacatttgttctgaggaaaacgtgacacatatatagaaaataacatgttctttgtaaagtgattaagcaaaagttcattgtgtctaggactgcctgatctatgaaagccatccctcctttaagaaaaccaacaaatgtccttacctggcgtgctcgaagtgctactttggcattggtggtcttactgagttgagttagctctgtgagaatattcagcagctcatcagtgagagtagggtcccggccacacaactgatcctaattgttaatgtaaaaaagaacatagatagtcatattaaaaagaacaggtggataggattttaaaatagagaaaaggaatgaaaacaaagtaaacccagctggattaataagaaaatgcaaacttcctattatttttaccctaaacaatgtggtaaagaagatcccagaggaagtttggctaaggagaggcagcccaaatccctcattcaaaattcctaatgtatttccttataaatcaacactatacttttaacacgcagaaggaatcattagagaccactaaaaggggccaaggggattctgagtaagaaataatagatatgtctcaaagttttaagagaaagttttaaacaacagggactaaaggccttcctgtttcccctcccacttttggaaagaaggtagatataaggcaaaaagaaccaccccagtggttttcatctcataaaccaaattttcagcaacccaggaggatgcaaaacagaaacacaagaataaattatttatttataaacacacactaactaaaacaccatctcatatgctggcaattctgcatcccaaatcatttctcttcttcctgtaccaagaatcattccatgatacttaaacatgtgaatccttagctgaattagaggaaaaaaacaggctcctactatagaatccatggtttattcagtattgggtccttcctcttctaagaagtaaaaaatgttaagaaaataatctcaatcatattctgagagaaatatccttactggagtccagtggaatatcagtttattccctaaattcatccattatccatgcaatttccatctaagctgaaaaaaatgtaaatgcagtttttataaatgtctgtcctttttgaactttacagagctactggtagtagtaattattaacaccacaccatataaaatatatccatttagatatcactacctctacttggagttttaaataattgccttggctgggcagggtggctcacacctgtaaccccagcattttgggaggtcaagacaggaggactgcttgagcccaggagttcaagaccagcctaggcaacatggtgagaccccatctctaaaaataaaaaataaaaataaataaaacaaaaaatttttaggccgggcgctgtggctcacgcctgtaatctcagcactttgggaggccgaggcgtgcggatcacgaggtcgagaccatcctggctaacacggtgaaaccccgtctctactaaaaatacaaaaaattagccgggcgtggtggcgggcgcctgtagtcccagctactcaggaggctgaggcaggagaatggcgtgaacccgggaggtggaccttgcagtgagccgagatcgtgccactgcactccagcctgggcaacagagcgagactctgtctcaaaaaaaaaaaaaaaaaaaattttttttaaagaattgcctttgtattttaataaatatttattctccccctactaccaatgggacatgaaagaagacccaaagggcctgcttgttgctgcatgttaatctccccactttgattatcagcccttttcttgaagaatttctatttcatacttaaccttccccatctcagggatactctttatagacctttatcacagaagtataaataaatgcagtataaataaaagacatgctttttccaaaacccctaccttccacatcacaaggtaaatacttttgaaatactcaatgccattatgctgggaaggtttctcaaacccttttttttttttttttttttttgagaaaatgatataatgagattctggttccctaatccaccaatcagaggtctgctctgactgtccagagtcataaaacatatgatgggagttataattaaggaagtgcaagtactgttttcacccatttcacccagataattcactcatctgagtgagaaaaataaaagctgctattaaagtgaagataaacccagaggttctattgaacaggtagcacagattagagaatctgttctacctatcctaggcataaaagcaaacaggagaaaggaaatgcaagtaagtctcaccttttgctgagaactaatgagcaaaacagaatttcaaaggaatatgtaaaactaccagaaacaggaccatagaaagacagaaggaaagaattgacagataacagtaggtagggaaaccaacataattttttcctacctaagtccctttcctaatgttcttaatagagcaaacatactcctttccgaagtacttactaaaagcattggaatgacccaccaaaatgcctaaaaacataagaagtctactgggtaatgccacaactcgactcctctgtacaaagccagactaaagtctcaacattaaaaacaaaagccaacatgacaaaataagagcactagggccaggcgcggtggctcacgcctgtaatcccagcactttgggaggccgaggagggcggatcacgaggtcaggagatcgagaccatcctggagaacacggttgaaacccgtctctactaaaaatacaaaaaaattagccgggcgtggtggcgggtgcctgtagtcccaactactcgggaggctgaggcaggagaatggtgtgaacccgggaggcagagcttgcagtgagccgagatccggccactgcactccagcctgggcaacagagcgagactccgtctcaaaaaaaaaaaaaagcacactaatcacctccgcaacctgtatcagatttgatatagaatgcattccctttaaaagaaatataggtttacctttacagatgaaactaaaatttttaaaaatggagttatcctcttgcatagttacagatcatgttttgttctgttttgttttgtttttaagacggagtctctctctgttccgcaggctggagtgcagtggcgcaatcttggctcactgcaagctccgcctccggggttcacgccattctcctgcctcagcctcccgagtacctgggactacaggcgcccgccaccatgcccggctaattttttgtatttttagtagagatggggtttcaccgtgttaaccaggatggtatcgatctcctgaccttgtgatccacccgcctcggcctcccaaagtgctgggattacaggtgtgagccactgcgcctggcagttacagatcatgctctaacttaaaagacaaaacaaagcaaaacacgtaaaagcacttttttttaaaaaccacttttttattttatctttccactatgagagaaaggcagtaaaaaagggcttcaggagaaaacaacagtatgtgtaagaaaagcgaactatggagattagaaaaaataaatgtgggccaggcgtggtggctcacgcctgtaatcccagcactttgggaggccgaggtgggcggattacctgaggtcagttcgagaccagcctgaccaacatgatgaaaccccatctctactaaatacaaaaaaattagctgggcgtggtggcgcatgcctgtaatcccagctacttgggaggctgaggccagagaattgcccaggaggtggaggttgcagtgagctgagattgcgtcattgcactacagcctgggcaacaagagtgaaattccgtctcaaaataaaataaaataaaataaaattaaaataaataaataaggccgggtgcggtggctcacacctgtaatcccagcattttgggaggccaaggtaggtggatcacctgaggtcaggcgttcgagaccagcctgaccaacatggagaaaccccgtctctactaaaaatacaaaattaactgggtgcagtggtgcatgcctgttatcccagctactcaggaggctgaggcaggagaatcgcttgaacccaggaggcagaggttgtggtgagccaagatcgcgccattgcactccagcctgggcaataagagcgaaactccatctcaaaaaataaataaataaataaataaatagataaataaataaataaatgtgaagtaattatcaaacagtatgaattaaccactattttcgttagtctattctgacttggaagttttccattcaaatattttctccactgtcatcattaatacttagaaaaaaattggcaacagaaaattatgtatagaataacttcctcaaccctgtcttgtccctgacctagacacagcattcaggttctgcaagaaaacatcagggtttttcagaaccacccatcttaagatgccaactaacatccaacaggaagtttattaccctctgtcctagagacaggcttcttttgggcaactggacaaacaaacatcaccatctaatcctggtgaacattttgtaaggatacctttagatggtgtctaggtcagcagatgtgtttagtcaacataaaaaggtttgtttaaagagccaacctgctgattttgggattacaggtcacttgcaaaaatctggcatcccaatccaccaaccaaaggtctgttccaactgtccagagtcataaaacgaagtgaaaattattattcagccatactggtacaaaacagttatttcttgcttttacttttgacctagatggtagctaactataggaaatagttcgaatttgcagaaatacaacaaacatgataaaacgttaaacccatagccaaggctgggcacagtggctcatgcctgtagtcccagcattttgggaggccaagatgggaggccgagaccgtttgagcacagaagtttgacagcagcccaggcaacacagtgagaccacatctttaatttaaaaaaaaaaaaaaaaagcatagccaaagttacacagttgactgacagaagaaaccaacatagtccaacttgatcttagaaggcaattcaaaacgaaaagaatgtgaccttatgtgtaatgccctcaagacattaactattatttagccgggtaggcactaaacccaggatcagcaatgaactggtagcttcttctagtcatatctgcactttttgatatcccaaaaaatgtcatagggtaagtttaacaattgttaatatcacccttattcagtgaatgtggaatcactgagaaagacttttcttctttatttacatattggacaaaattatttgcagtcaggttaagtggaggaaggaaaggtgctgatcagcatcataaattctccccatctaaaccaaatcaggggttcataggcatggcattactcatacagaagcatggtttatagcatgttcatgtggaccgtatcaaaaataagttacaagtagtgaggggaagactacttaccatcaaggtggctagaagatatgtacattgccatctagacagctatgaagatgttgatactttgtatttgtaccaattagcttaatctggctaaagattaaagagttccttaaatatctctaagcaaacataaacaatgttctgagttctaagctttttcctataaagttaaatttaagaaataagaagagctttcaaaaaataaatgtactattggtcttccagactttgtgttaaattgtgttacaatgtccctttaaatggaggaaacctgataggactttagccttttacctgatactttgctttccagacagagtgaaagattaccagaaatctgcttgagagtccatgaggcaagttaccactgggcaggttatgctaacacctggagaggatgaaggtacctctttactagagcaacgcatatcccatgacattgactcacggaagcctgagtttcttgatacctccctccctgtaggttcaaaagccccagaaatcatcatctagctcagcaaagcatactatcaacattcctacttctagaaagcagagaatggaatactgggcacataaccatcaatcaggaagccaagatatgcaaagaaaggggaaccagcagagaacacaagctgggggagtcaaagtgctaccatgtgcaggtgacatctgtaaaagatactaagatccgaggaaagaataatccaaacaaccaaaatggctcttaccagctactaccattaatgcagatgtgggagaggaggagggagaggaagaaggaagggggagcagctaagcgttgtcaaagaggaaaagaggaagacatgtctggcattcagtaacatcagatcagaaaagagcaccgtcttgagcttttacccatgttccataagtcactgctagctggccctgagcttgatcatatcattaacttcttgatttccaaatctctaagatgaaatgaaaacaactgatatttgaaaagaaattaatgacatgaaagcttagagatcctcttatgtttactgggtctcattttgtttttgttttttttttaaagaaaaatgtaatgacaccaaaataaagaaagggacaaatctggcttcctggttcacatgttcaaccgtccttatcctcctcctcctcctcctcctcttcccatcccccttgtcctcctcctcctccatcctattcacccaaactcaaactctgaaacagctcttttccctaaagagctcagcctgttggaaagaaagtctgggtactatccatgcaggtaagaagtaatcaggatgacaaggtgggagaaaaaaagaacagcgtggaaagtcagagtcccattggcttctgcctgtcctgactggcaaaagcagaaagcaaagcctcaaaccagttctctgacagggcccaacgcctctgcagcaccccccgcgtaattacacacttgagtgactggactctgaagaaaattgaaggcctgagctccgaacagctgccattttctctctccatcacaccagcgtgattacttgagaaatgaacagccctggctcaaagctactccagaattctcagaggaaatatggctccgtgttccaataatgagattcttaaggcaagcgttacttacaatcactccgcaaaaggagcgagctgagcccctatatcttacaaattagaatttaagaaacccagcgacagtcttggacaatcattactcttccgctgctccaaggattctaggctttggtctatttttagtgcagaaaactgttaagttcttaaaaacgtaatcacaataaaaagaaaaactcaccataattagcttcctataaaggcaaattccaccccattctaggtccaaactgacagattctcctaccctcctcatcattacccttttctgacagaaagtcttggctttatccaaatgagatttaacaatcctttcattaaattaaaaaaaacatctaaatagtctttcttccttcttttgactgacaaaaaaaattagcaagctgccatagattgtatcatttcttagctgaaacctgtcacttgggggaagttgaagtattacattgtactaacatatatatttttccctctcaactgcatctttctcgtttccctaccatctagctattctagggtagcaaaggcaatgaactctccctataattacatattttttaaagtggctattctaaaaaatgtgatacgctttagagttaaccagctaggcatataactgaatgagtggcactcttgttaatcagaggtgtatggtagatagtttcccttcattctgaagaaataaaaaatagcatgaagatgtatgtttttttcctccatgaaaaaatgatgtaattaacttaccaagaatcccaattccacaaagagacaaaaagaaaactctaggagtgaaaaggcactacagtccccaaaaagacaggcatgcagcagcaaggcaaatgctcaggaccatggggtgagggactctaggagtagtcctactgtactaattcctacaactaactcaaccagaatgagctaggagtgaaggacttgcaagtcatctttaaaaatccttcagcccacaaaaattccacccactggctgaatgcacattagctctcatcaaacttaccaggctcactccctattcctacttcctactaattcttattttactaagttatagggaaaaaaatcatacatttactaccaatacaataatccgagcttagattttcaatgtaaataaaaagggaccaatgaagatgcagaatacatttaaatttctctggtcagagagggggagtgctggatttctatttattttttttcaagtttgacatgagagccattgcttgtatctatggaacaagagttaaaattagaatatattggctaaataagatgaaattttaaagctgctgtcatgatgaccacaggaatggtgaagcacgaggcatttctaaacagagttaggaggtataagttcctgtgaatgagtatatgcataatggccagaagagtcattttctcactaaagcaggttccttcagaccaaggacaaaggtagacgtgagaaactgttaatccacagctcaagccccattcatcccataattataaaaggcagtagttttttttctctggccatagccatcaaaaggaaaaaaatactttttgcatatcattgacggtctttacaagttctgaaaaatggtactcacaataagcattgtgaccagaagattcttcttggtgacttgagcgtgagagaagatgtagttcagtacagtgttcatgtcacttttattctcttctcggagggcgaatacacatttgtcatagtgacctgcacaccatgaaaagaactggttctcacccatgtataaatgttcacatttacatgctatttgttttgtactgtctataatttatgagacgagcagtgagaagaaacatcataaggattttcttggatggatttgtacagaaactggcaatgtgatttagtaaaaggaacactggactaggagtcaggcaatttggatataagatctgggttcaaggcctagttctattagcaatttactgtgtgctcctgggaaaatcattttacctctctgggcctcaatttcattaaattttttaaaaattggggaggtgggtgtaccttaaagactgaaagattgggaataactcaaaccccagtcttactctaaactctctcatgatttctttagacgagaaatttctgtttaaaaagaaatgtaaatatcattaaacttgatgatctttaaggtctcccccagagcttgagattctgattccatgtttgacttgcagaaaatagttgaccctaatcagtaggaacagttttagctcaaaaaataaaaccacaccaaacttagcaatatccatgagaagtgtgactgctacccctggaatcaacattttcttctgttagtccttgaaacagctaagcaatgcctaggaacgccaaatccaacccaaggtatagatcaaggagaaccttgcattaagtcaaaaggtctgtagggagactaaagttatgcatattttcacttgccttccctaaggccaccaggggcaggttagttctgagtaggaaagctatgttttacaacagaagcataagcctctggtacactgtagtgatatctgccatgggatataagtaatattcagttctttagaaaacagcttacctcagaattaaatttccaagtaaagaggaattagtgtttgaatattctcaagggtcagaattttatgaaatcatgaaaacagtaaaggattatcacctcagttcagattccacgttaagttacaaaccagaacagtgacgttcaaactgcattatcatggtttcctagaacactgagtacactggaccagtgtaaccaggcttttaattattctaaatattagagattgacataagcaatttttttccaaataaaattatatttgaaaaacaatggactacaatatcgagagagctgccaatttcataaaagacacatttagaccaaaagggaagctgtttaaaaattagctgttctgcattaatatttttctctaccaagacttagctttgaagtgacaacacaaataaactttggcaataggaccaggggaaataaaaagaacacatttacccggggtgaggggagacattaacagaaagaaagcaatgatactttcttgttttttttttttttactttgaagatcctgcataccaagacactcttttttaaaaacacttaattggctgggtgcggtggctcacccttgtaatcccagcactttgggcagccaaggcgggtggatcacttgaggtcagacatttgagaccaggctggccaacagggtgaaaccccatctctactaaaaatacaaaaattagccaggcatggtggtacacacctataatcccagctacacagcaggctgaggcagaagaattgcttgaacccaggaggcagaagttgcagtgagcagagattgcaccactgcactccagcttgggtgtcagagtgagacttcatctcaacaaaaaaagaacacacaccaaacaaaaaacaaaacaaaacagtttaattatgaaatatatatacagaagaatatatagaatatatggtatcagttgaaataaacacccatgtgttattttaaagccattacattttaatagaacatctctagtatctttgaagacccctgcgtacccctcctcagaaacaactactaagctgaattttatgttaattattcttttgtttttcttaacttttatcaccaatgtatgtatagcttaattttcctggtttttgaacctgaaaaaaatggaatcactgtaccatttcttttccttaacattgtatttttgagattcatccttttgttcagtgtatgccttggtgcatccattttcactgctgcatagtaatccatggtaggaatataccagacttcaatgatccactctacctatgtatatttagattgtttcttgtcttttttaagattatgaacagtgctgtcacaaatactcctgtatatgtatcctagtaaacatgtgtaatagtttctctaaagtatattttctaggagtaaaattactaggttaaagaatacaaataagttcaactttattaggtactgaccaactgttaccaaagtggtatataccaatttgtacttccatgtacagaagcaatgaagatgatgatgtgacttttaaatttttgccactctcattgtggttttggtttatatgcctctaattacaaatgggattgagcatctttgtgtaagtttataaattatttgtacttcttcttctgtaaaatatctttctatatcttttgcccatttctctattaggatgtctttaacttgatgattcataccaattctctagatacttctaattattttttaggtatatattttgtaaatatcttctcacactttgtagcttatattttcagtctctttttttggagactgtgtcctgctctgtcaacggggctggagtgcagtgatgcaatcacagctcactacagcctcgacctccccaggctcaggcaatcctccaacctgagcctcccaagaagctaggactacaggcacataacactacacctggctaatttttgtatttttttagagacggggtcttgctatgttgcccaggctggtctcgaactcctgggctcaagcaatctgccggccttggcctccgaaagtgctaggattacaggcttttcagactccttatgacgtattttgatgaacagaagttcttgagtggagtttaagtaatcaatcttttcttttgtagtttgtacttgctgtgtcttatacaacaaaatcttcctatcctgaggttataacgatattctcctaaccatttaacagcttcacctctttagtacatatttaagtctttatcgggaattgatttttgtgtataggcataagatagggattccatttctttctttcctctttttttttttttaaatgaataacccattgtgctggtatcatttattgaaaaaaaaaaaaatctatcctttccccatgatctacaatgcctcctctatcataaaataagttttcatatatggctggatctgtttctgggtcattaagttccactgatctataaatctatctctacacctatctcacaatttcttaattaatatggctttatattaaatcttgatatctgattaggcaaatcttttcaccttgtatttctttggaagtatcttggttattgtgagacttgtcttttatggaaattttataattagcattacaaatacactaacagaatttttattgaaatgtcaatctacagatgaatttaggaagaatcggcacctaatagtgtacattccaatttaagaccttgataatttatttaaatcttctttactattataatattcttgattataattttcctcaaaagaggcttgcacattttttgttagatttactccttagtatttcatgttttgggttgctattttatcaactaattaattaattatttagagacagggtcttgctctgttgcctgggctgagtgcagtggtacaatcatagctcactgcacccttgaatccctgggctcaggcaatcctcttgtttcagcctcttgagtaggtaggactataggcatgtgccatcatgcctggctaattgtttttaattttttgtagagatggggtctcactatattgccaaggctggtctcaaactcctggcctcaagcaatcctcctgtcctggcctcccaaagtgctaagatgacaagcatgagccactacatctagcctgctattttaattttttttttcctgaactgcttttctaaacaattgctctactgtaaacaaatactgttgaattttgtatgttgacttttgtatttagcaatcatgttagattttaaataatttaataatcaatctgtgaatcctttgaggctttctaaagagacaccctatcatatttaataatggcagatatattgctttattactttctagctcttataccctttaattcttttccttgtcttactgcactggctaggacatccactataaagctgaatagaagtagtgacagcaggcatccttgtcttattcctaatcttaaagataatgttttcaacgttttaccataatgcatgatgtatcctgcagatttttttgtgggtcccttttacaagattttaaaagttccatttcactcctagtttccaagagtttgtcatgaatggatgttaaattctgtcaaatgctccctctccacaccctgttatcttgagataatgagcatgtttttcctcctttcatctatttcatgataaattatattaattgactttctccaaactgatcaaccttgaatgcgtgggataaagccaacttggttgttatgtattattttgtatgttattggatgcggtttgctgatatctacatgaggatttttgctggtcatgagtggcataggctgcttttaaaggaagtgaaaaggagcagataaaggaaaatgtttcaaatttcagataatgtttcaaattctgtgatgtttcactgccatcttgtggcaggaagcaatgtcagcagtaaacagctttaaaattttagccaaggttatttcacacttaagagacaatttatcatttagtgaagctcttcagagaaagccagggataaagtctacctaaatgatatactaaaaagtattggaaaacctgaacttgctcttcctagatgcctctggttcaattcatggattagctgccaagaatcaagctcttcagatatgggtttctcaatttcagcctgtgatgactcaaccaacttacactacacaaggtcaaaaagatatcaacaggaatggtaatctctattagaaaaattacttcagccctttctcagaagcacactggattcctaatttcatcaagctgtgtttcgttgttctttctttagagctagtggatatagaggtttagtttttaagggagtagtgataggagactgtttattaatgggaagtgttgttgacaggagggggcttagctcttacacagtcctatagggatagtttgggttggttatcagaatcaaggctttcttagctagagagtcctcaggaagaggcttaccattctggaattgtgtctctactcgcaggtactgccggagcagatccatcaccacagccttcatgtggcctcggatgccacttcggtacctaggcaaatagaaagtctccactgaaaaacctgacaatccaacactattaagcaataaacccaaaggccaaatttacctccacgacattccactgaactgctttccctctgaataaagaacagcctaaaatgaactacaaaattaacttaaattctaagcctaaaagaaatctcactatagacaagaccttttttaataaagaagacaacaaaatcctgcatagccccacctaccaacaccttgattcagttcctactgctaagtagaaattattaccatactcttgaaatggctgagatatctgaaaaatttataagtatcttaaagttaaaagtgttctgtgaggccggttgccttagctcacatctgcaatcccagaactttgggaggccaaggcaggaggatcacttgagtctaggagctccagaccagcctaggcaatatggcaaaacctcttatctacaaaaaatacaaaaaaattagccaagcatggtagcatgtgactgtagtcccagctactcaagaggctgaggtgggaggattgcttgagcctgggaggcagaggttgcagtgagctgagattgtgctactgtactacaacctggatgacagtgtgagaccctgtctccaaaaaaaataaataaataaataaataaataaatatgctctgtgaatatccctttagtattaatagcaacaaccacaattacttttgcaccaacctaatataataggctccataagctaagaagaaaaaatgtcatactgggccctgtgacagaagaaaaattaggagcttcatcaaaatggcaaggaaaaagaaaacaacaaaatttctgtgccttattaattgacaggctggacgcagtggctcatgcctgtaatcccaacagtttgggaggccgaggcgggtgggtcatttgagcccaagagtttgagatgagcctgggcaacatggcaaaaccccagctcttctaaaaatacaaaaattagctggatgtggtggtgcacagctatagtcccagctattcagaggggttgaaacaggaggatcacctgagcctcaggaggttgaggctgcaatgagccatgattgagccactgcactccagtcggggcaacagagtgagatcctgtctcaaaaaataataataataataaataattgacagaaaaaaatgtagaatattaagaagtcagaaatattgagcatgagagttagctcacaattctaagatatttagaaaagacaaggtactttctaagatataagatgctttccaatttcttgaagtcaaatctgaggtaaatttttttgtgaccacttgaaagaaaggaagacatgagtatggacaggtctgggaatctggagttacaagttactacctctgtaccagctgaacaatgctctgagtattcataaagaagacttcccgttcagatttccggttcaatgtagctgcatggctatctaggatgtttgcaatctaaggtataaaaaagggaaaaaaatgaggcccaacccaacaaaatgccccaaagcatcagcctctatagcacgaccagtaggaatcttcttcttataacatggcagttcctatctcacatgttggcagcagctggaagttaccaggcgtagtctatatagagaatcacgctacataagcaagcagatttcatcccttgtcaccctttcccagatgaattaatgactacattacaaaaactatcatcttaccaatatctgttcaaggtcaagatccaaacatcactccccacttatctacctatattccctacacatacatctgctttatgggtaaagagtaaagatgctgccaaggtagtaagaatgtctctgaaaataaaactaccaataggccatgtgtggtggctcacacctgtaacctcagcactttgggaggccaaggagggaggatagcttgagcccatgagttcaataccaacctgggcaacataacgagacccccatctctataaaaattttttaaaaattagctgggcatagtggtgcacatctgtagtcccagctacctgggagactgaggtgggatgagccattgggcctatggggtcaaggctacagcgagccatgaccgcaccactgcactccagccttggcgacagagcaagaccctgtctcaaaaataaataaataaataaataaacagctgggcatggtggctcacgcctgtaatcccagcactttgggaggccgaggtgggcggatcacgaggtcaggagatcgagaccatcctggccaacatggtgaaacccgtgactactaaaaatgcaaaaattagctggcatggcagcgtgtgaatgtaatcccagctactcaggaggctgaggcaggagaattgcttgaactcgggaggcagaggttgcagtgagccgagatcagccactgcactccagcctggtgacagagctagactccatctctaaatcaatgagtgaatgaatgaatcaatcaatcaactaatatcactctattttcaattcatgaaaatacctctaattagggaatagccccaggaacaaagctataaggtatacatgatccaagtgtgcttttctcataactacagatacttatccttcacatacagtactttcactgttgggtttgtaccctgaggcagttttgtgaggaatacaatgcttaaaagtatacaagcacaacatccaaaaagtaaggaggatccaaataggaaggaatcctacaacataaactctggcattggtagccagaaaaaaatatagtgttatcctataaatacctgctggctgggaaactgacagaggactgatgtgatgttgctagcatactgagccatttccttcttgatagacttctccacattggggggaatgcggccagacacactggtcataatatcttgcaattctaggagaggcagggagggatctctgagggttttcatcaatcgctctacccagtcttttacctagaaagaaagcattggtaaaataggacccaagttaacacaatcccccaaataaaaagatatatagttgtcattctgtatacgtgggaaattggttccagaaccaccactcatatatgaaaatctgcacatacttgagccctacggaacccatgtatagaaatagttgtgggttccatatctcatcaatactgtaattttgatccatgtttggctgaaaaaatccacatataagtggacccacacagttcaaacctgtattgttcaagagtcaactatatctgaattcactatcatatactacttcttttcaataaaaatttatataattttcaatagatatggggtcttgctatgttgatcaggctggtctcaaactcctggcctcaagcgatctttccatctcagcttcccaaagtggtgagattacaggcgtgagccaactatcatagagtactttgaaattgcaacgtaagcatctaacattgcccctattctccagtttaaaaaggactaatcacgggtgggcacagtggctcacgcctataatcccagcactttgggaggccgaggcgggcagatcacaaagtcaggagttcaagaccagtctggccaacgtggtgaaaccccacctctactaaaaaaaaaaaaaaaaaattagccgcgcctggtggcacgtgcctacaatccccactactcaggaggttgaggcaggagaatcacttgaacccaggaggtggaggttgcagtcagctgagtttgtgccattgcactccagcctgggcaacagagcaagactccgtctcgaggaaaaaaaaaaaggagtaaccacaattaaatgtgaagtccatgacaaggataagaaacatggatttaaagacctcaagtcccacaactgaaggtgaaagagttctaggccaaacagctttcttttcctccctcttaaacaatcattatgagacttggaactattttggagaataggtatcccatttgtacatcccttccccaggagacgtgatacataccttgctgctaaagaaaggatctggaaggcagtatccattcattacattgaccagattatccaggacataatggaacactcgatggagtttctcgcctctgagtgccgtgctctggatccgtggcagactacctgtgtgaagttcagcctgtcaaccccaacaagagatcaagtcatctactacttttgatctaaggtacaaacacaccactgcacttaagagttatcattcaaaatcgagacatcatacccagctaccaggagggaagtcaatagaggaaacatcataaggaaattacagaatcttagtactacagtaactcttgcaaactctagttccataatactacaggcacaaatacaaggcataagattaataggggacaaagctaaagaaaacactggcaaaccaagcattgaaatcacttgcctctccaaaccaccaagttctttagctcttagagagcaatattcggagcaccttcctactcacctgctgaaccttgctggggttgtccagttgcattttggctagtacacagccagggtcaagagctgctccaggtcgcttgacgtaatggatacagccagactccacagctgttaaggtcattaccatcttcattacctatagtgaaaaataaactagactcagatttatctctctttacacagatgagtgcttaaaagaactaaaatttttcccttagcatctaagttggaccacacctaatttgaccaagaaaaaatgggaatttaccatcatctcctagggactatcaaggcaagcaattagaaaatctctcagtacctcactttaggaattaataacagttattgacatttctcctttctaacttttacaaccattttggcataatttgtgattatatttgttttgtacttagaaagtaaggaacaatttaatatcctcataccagtgaatccaatctaagacaaccaggccaaaacctaaggatcattcttcactcctctttctcccttacctaccaattaccaacccagccagacatatcttctaaacctttctcaaaaatcttcctctcttgccatctcttcggtttacgccttcttcatttctggcccaaagtacttcaaagaccccctaagagatctccctacttgctacatacctccctcaaggtcacgaaaagcaatcttcctagaccccaaatctcatcatactacttttccacttaaatctttcagagattacctgctgcctccaggatagtgaaaacttactagtatggtttataagatccttcataacctcacattcaagatctcacattacttctttagcacctttgcttgtccctccccattaaaccttagtctattctcaagccacaccaacacatacttgcagttccctaaatacactgtgctgtcttgcttctgtctttgtacatgctattccttcaactttaagcactcttccctgcccttcttcacctgctctatcactatctgtctttcaaaactaagatcaaatgtctcttctttcagaatatcttcccatacaagcttagcttgatttgggttaggtgaccctctgcactctatgcttagctctcttaaaattaatcacatgacatttcttgtctgttttgtgccccacctccatgtattttctctggatagccagcagttaggacacctaacattcaacaagtgctattgcctagtatctatttttagaactagagattcctcatttgcctatgtgttttaaaaatcttaaggttcgcacttctaattaagccaactgatgtttctttttcattcttatttccaatctgttacctttttttttaattttttagaaatagggtcttgatttgtgacgcaggccacaaattgtaccactccagtacagtggtacaatctccattcactgctgccttgaattcctgggctcaagggatcctcccgccttagacaccagagtggctgggtctacaggcatgtgccactgtacgccgctaattttttaatttttcatagagatggggtctcaccatcttgcccaggctagtctcgaactcctgggctcaagcgatcttcctgcctcagcctcccaaagtggtaggattacaggcacaagccactgtgcccagcctcctttctgtaacttttcagtcctagtccatcccagccgacccttttcctaccttcccctcccatgatcccacagtcctttcaccaccctgacctcaatctcagcatagcactggccggcaaacacatgacctccatcttctacaatgtactggattaacttcccagcagaaggtgagcgcatcaccgatgggtcattttccttctcaaacacacaggttttattgccaattgtgatgcgatatctaggagacaagtggaagtatgtaagctaagaaagcacctcaggatgtaaaggagaatggtagagaatgtcaaccttcaaagaaaaaaaatcctgaaaactttattatacacacacacagacatattcactgcatatttgtttacaatgtcaattaacataaatttccttcaataaggatcagattaaatatagtataatcatataatggaataccacatgactattaaaaataacaggtaccaccatttaaaaaaacacacacaaagatattgatgacgtaatagctaacatttcttgaagcctagctatgttgtggcaatgttctacacattttcaacatgttaatttatttcattctcataacaccataactggtgttgaacatttgtgaatttcttttttttttttttttttgatacggagttttgctcttgttgcccagactggagtgcaatggcgtgatctcggctcaccgcaacctccacctcccaggttcacgtgattctcctgcctctgcctcccaagtagctgggactacaggcataagccaccacatctggttaattttgtatttttagtagagacagggtttcaccacattggccacaccggtcttgaactcccagcctcaggtgatccacctgcctcggcctcccaaagtgctgggattacaggcgtgagccaccgcgcccagccacatttgtgaatgtatttaaagaaaaacagtatgtacatgagtgtaacttgtatatgcatataaaatttctactcaaatatgtaagaaacttttaacaatggttacttataaaaaggggaacttatttttcattgtccacatacactggagtggtagggagacatgtttttaattataaacactttaatactcttgatatttttgttaagtgcatgtactattttttttttttttaactacaaatgagtaccaagaaaagcctgggaaaatcccaagagctagtagctaataagagaaaaggctaacaggatgaccagcaaatggacctcaaacagccacttacctatccacttcctctttcatatacgtagtataactgctgccatcataggacaagagcagtccaccgtcactcagccgatgtacatctacttctacacatgagccattcatgatcaccacataggagttgggggactgtcgagtcacctgtagggaatgagaatgaggatcagtgtgtcccttccaggtacagctccaaatgaaatttgaatgcttcaaaaatacagataagaaagatctgtcaggaggaagaaaattcatggcactgatgctatttgcatcagtgtctgtggacatggctcagtcctgctgtaagcaaagagggcaaccttagttgattttccccaactgtggttgttccctgtctctcctttatctcttggcagtgtatgtgaagttgaagaacaacaaaaaagattttcatagaacaacaaacgctgcttcaggacactgacaaaaataatgacggtaatttcactaatacccccatccctgcattaaatcaaactttttctcctgcctctcaacctaaagaaagatagctaaaaaagtaaggtgcaagctccaatggggttctgcataccttaagtacatacttgactccctcatagataagttcaacatctactgtattcagaagtgtatgagcaggaaggacttgacccctgaaagaacgatgagagaggaacttactacaaagttctaacagttataagagaatctaaaacattattgattgtagcatttcctagaataacaaaagactagaaacaacctaaatacctaaatgatcgtttgtaaggaattgatcacatcaattatgaatcttacaatggatttttttaaattagggtaaaatacacattacattaaatttgccatcttaaccattacaaaatgcacagttctatagtgttggggatattaacactattctgcaaccaatctgcaggactttttcaactggcaaaagtgaaactctacacccattaacaactcccaatttcgccctccccccagttcctggtaaccgtcattctactttctagttctatgagtctgactactcttcatacttcatataagtaaaaccatatagtatttgtctttttgtgacaggcttaattcacttgccctaatgtccttaagatccacctatgttttagcatgtgtcagaatttccttcttctttaaggctgaataatactgtattgtatgtatatgccacattttgtttatccagtcatccatcaaccaacatctgagttgctcccatcttttagctactgtgaataatcctcctatgaatgtggctgtgcaagtatctttcagaccctgctttcaattctttcagaatacccagaagtggtattaccagatcatagggtaattctatttttaattttttcagtaattgcaataccatttttcaatagtggctgcatcattttacattcccatcaagagtgcacaagtgtcccaatttctctacgtacttgccaatacttgctattttctgttttttgacagtgggcatcctaatgggtgtgaggtggtatctcatcatggttttgattttatttacttaatgattagtgatgttgcgcatgttttcacatgtggaacaaaacatacagacattaaaaagatgtgaactaaaaaacactttaaaaaatatactgttgagttaaaaaagcaaggtaaataacagcttcacagcatgctaccatttgagttttaaaaaaccaggaggtgggaagaaacaaatattgcatgttgatatggttcggctgtgttcccactcaaatctcatcttgaactgtagctcccataattctcttgtggtgtgggacggacccagtgggagatacttgaatcatgggggcggttcccccatactgttctcatggtagtgaataagtctcacgagagctgatcattttataaggggaaacccctttcacttggctctcattttctctcttggctgccaccacgaaagatgtgtctttgctcttcctttgccttccgccatgattgtgaggcctccccagccatctggaactgtgactcaattaaacttctttcctttataaattagccagtcttgggaatgtctttattagcagtgtgagaacagactaatacacatatatatgttcatgtaagtttagggtatctttggaaggttagaaaagaaattggtaatatgaatttactataggggacggaaactggatggccaaggaacagaggtaagagagagacttctcactgcttatcttttttgtgccttttgaattttgaaccacatgaatgtgttaactgttcttaaagataaagattaaggttgggcgcagtggctcacgcctctaattccagctatttgggaggccaaagcaggcagatcacgaggtcaagagatcgagaccatcctggccaacatgttgaaactccgtctctactaaaaatacaaaaatgagctgggcgtggtggtgcgtgcctgtagtcccagctactcatgtggctgaggcaggagaatcccttgaacccaggaggcgaaggttacagtgagcagagatcacgccactgcactccagcctggtgacagagcaaggctccatctcaaaaaaaaagattaagattaaacgcgaaaaaattataaaacttcagtgtaagcatatctgctcctagcaactgaaactttatttgagagtctttaaaaaggccgggcagccgggcacggtggctcacgcctgtaatcccagcactttgggaggccaaggcgggtggatcacaaggtcaggagattgagaccatcctggctaacacggtgaaaccctgtctctaataaaaatacaaaaaaaattagccgggcctggtggcaggtgcctgtagtcccagctactcgagaggctgaggcaggagaatggcgtgaacccgagaggcggaccttgcagcgagccgagattgcgccactgcactccagcctgggcatcagtgcgagactctgtctcaaagataaaaaaaataaaaataataaaataagtaaaaaacaaaagcattttaaaaggaggtgggtggggggcttgtagaggaaaatgcatttgacatatttgtacaccaataagaaaactatttaactaggttacagattatatgttgcagaacagaaataaataagactggattggtaaaaagcggcccatgtatacagggagttgaaagtcacgccaagggatttagatttgatacagaagagaaatgccaagctgctgaaggttttactacatgagagtaacatagtgaaagatacttatcataggacttgaataactctgaaatctcagttcaatttttaaattttgtttcttttctttctttcagatacctcaaaagggagttgatataagtctaacaacacagaaggaaataaaagtgcctgtgattaaagtgctttaaaatgattagccacttggaacattcctctggggactcaaaggcagagcttagtctcctcaatcagcaatagaaattagtttagccccatagatgtctgaccctctacttgaaagactcatgaggtcatcctgaatatcagccttaattatttacttctgaaaggtggtacaagtaatacatgaaatatttagggttcagtgctagggagaaataccagatttttatcaccagggtttggagagatttgatacttatacaggacagaatatctactgcagatggattccagtttttaaagaagcaacctgttctaactgtggtataagttaatgtctagaatctgcagtttgactccccaaataatttgccataaatgtcaacatcccctctctttcttgccaccatggtccatgaataacaagtagcactcataagctgccaggaatggacagaagaataaatgggtctttgagcttcagtccctgtactcagggccattgattagtttgtgtagcctacaagaaacaaagcctacctttctaaggagtgaaggaagttagagacgctattccgcaggctcacatctgccacgtggagggcaccacacacaacccccaacatggtgtcaggtcgctcagcctgaaaggaggaaaaagagggcagatcaaatgcatggtcacttggcaccacagcctctcaaatgaaatcaggctcaaatttgttgtgatgaaacagctagcaatgaaaatctccattctcactgcccaactgattttttagataaaaatgaacacattcacttttagaatttgattagaggcaccacttgaagagaaatgaaaaacaactttcttcttttctccctaagacttccacttagccaatcattgaatagctcaaaaataggcttctgacagaaataaatttaaaaagacacaacgatttggctactgataatctcaaagaaaaacggtgtatagccaaaatttggacctccaaattatatgaatctaacgattttatacaaaatcttggataatttagcatagccccaggaattaaggaataagtgataactcttgatctaaatgaggcctctctcttcagcatctggtagatacagaagttggcaactatggaccaggtttaacattaaatgaagaaaaagaaagtaattaaatccctgcatgcctcacttcaaatatacctcaggaagtaatgctagaacataaaatgactgtgtgacacaagcacaggaaccatcagagtgctaaaattacactgactcctagatttttccaggtagatcaagaaccatttacattagaatcaaataaatttcatgtagtggcagggattgagtacacaagtctataaaaacccaatcccagcatctgtttgtggagaaatacacacctgtactttttctgctatcagtctgtccagccagccagtatcaattctgttcatctgaaagctttcagtctctaacaatttgatcaggtattcaactgtagttcgaaagtcaccccgaatagacagctccttcaaagccaccaccatgtttctgggagaacagaagccaatctgtttcagcaacaaacactttaatgtttttcaataattttaaagatctgtttggccaggcatggtggctcacgcctgtaatcctaacactttgggaggccaagacaaggcggatcacgaagtcaggagattgagaccatcctggctaacacggtgagaccctgtctctactaaaaatacaaaaaattagccaggcgtggtggcgggcgcctgtagtcccagctactcgggaggctgaggcaggagaatggcgtgaacccgggaggcggagcttgcagtgagcagagatcacgccactgcactctagcctgggcgacagagcgagactctgtccccccaaaaaaataaaaataaaaataaaagaaagaactgtttcattcctttggaatcttgagagggaagggagagaggcagttccaaaaacaaataagggtgcacatgtcaagtgtgctcattcatgtgcattcaagagagggaaatttgcaaaaagtcagaaaacgtatgaattctaactgatattaccataagagcatcagcaaatcagaaacatttcattataatgagtacagaacaaattataacaaattatatgcaagtcaccctcagcttttacttactaagtttccattattccattcatttgttgttggctaacaagaattagggcattaattctccctatccttgtaccttatttattttatgtataatttacatacaataaaatatacttattttaagtatacagttcaatgaattttcccaagtgcttaatttaaagatttccatacagtaaagcaactctctgggtgcagtcatatatcagcctgacactgcatgtgacagtgttttttttaaaactgcattttggatatctatgcaatgatttgctcattacttttattacttcccagttaagtgcaaagtgatccaattttagcagaatttcaaatactatggggcttttctgtatatttatgcccagtgtctatcctgcatgggacaggtacttacttccacaaatactaattatgtacctcatactaataagacacatactatgattgtaaggaagaacataaatacaataatcactttcaaaatatatggcagaatatcatcaatgccagacagaatacttacacaaagttctggagaggttgtaagaagggagaaattcatctccctacagtttcatgaaaaatgtggaaactgacatgggctaaagtatagctgataattataactgtgagaggaatcatattccaggtagtccaggcattccctcagcctaaaatattattctgttgcccacctctgtcctcctttctgtgtcctcctttgacctgacttacttctacaaacttcaattatcaatctagatgtcactgtcttctgggataccttcccagaacccctctagactgagttagttgactcatctgtatgatcctataatgcccttaaataatctgactatcatcatacttaatacattgtattttaactgccaattgtcttacaccctctggattgtaaagttttgtgaggagagagattctatcttggacctcactgtattgccagaaccagtagatagcagatactcagtaaatatttgttgaatacaatgaatgaatgggcctggcacagtggctcacacctgttatcccagcactttgggaggccgagttgggcagatcactcgaggtcaggaattcgagaccagcctggccgacatggtgaaacccgtctctactacaaatacaaaaactagctgggtgtggtggcgggcactccatgtcagaaaaaaaaaaaaaagaataaatgaatgaacagaggaaatagcaagaacaaagaagcagagggaagaaaatacaggttgacaaaattagccaggcatggtggcacgtgcctgtaatcccagttactcaggaagctgaggcaggagaatcacttgaacccaggaggaagaggttgcagtgagctgagatcgtgccactgcactccagcttgggcgacagagcaagactctgtctcaaaaaaaaaaaaggaaaatacagcttgagttcagggaatggtatgattgaagcagaggtataaggataggaatgagtggctaatccattcaaccaacgtttactgaatgcttactatgttcaggggatatagcagcaacaagacacagtcctgttctcatggtatttagattatgacccatgggaaattatactggaatatactggaatatatgagttggggcattctggcaaacaagagtccaaaccccaagctgagatatagacctaatgaaatgaagaaataagaaacaaagaaagctctaagctgaagaatgaacttttggcatagtgtcaagaaggagacttattgtagataacgtatttttaacatgctaaaaattaagctagttagctttgtactgtagacaaatgtacagagctggtcagaaataaggaacaaggcttctggattgggttataggacattccctgaagaaaatacacagtggtctgccaaatcaggacttaaacctaaatgccaacagaggccagtctgggaacataaatgagtgaggcagactgaataggagctgtgttaactacaaagtttatgtcccgtcgaaaagaagcagtcacacaaaactagctgttttttgtttgtttgtttgttttttgtttttttgagacggagttttgctcttgttgcccaggctggagtgcaatggcgtgatcttggctcactgcaacctcagcctcctgggttccagtgattctcctgcctcagcttcccgagtagctgggattacaggcagttgccaccacacctggctaatttttgtatttttagcagagacggggttttaccatgttggcgaagttggtctcaaactcctgaccttaagtgatctgccagcctcggtctcccaaagtgctgtgattacaggtgtgagccaccgtgcccaggcaaaattagctaacttttaacaactagaatgtacaaccaatgttgtcattatagtcctacttttaagagctagcagaaatccatattttgatttcaatctcctgattttttaatattgtcaaattaaaaaaaattaacactttgtgagcccatcaaaacacatctgtatgttgagactcaccagaaagccaacaatttgcaagctctagtgtaaacctttttcactttgcagagcataatatggcagcgaatatgcttaaaaggcaacttcataccaatgtttttttctggtagcagtgttttaattttgaaaaattccacttatagttttgaagaatgagaagaaatgtaaaggacaaaatagagaaataatgagatttccctacttctaaaaataatattaaaaactaattaatcaaggctgggtgcagcggctcatgcctataataccagcactttgtggggccattagagcccaggagtttaagactagcctgggcaacaaagggagaccccatctctacaaaaaatttaaaatttgctggacatgatggtgcacacctgcagtcccagcaattcaagaggctgaggcaaaaggattgcttgagcccaggaggtcgaggtttcagtgagctatgatggcaccactgcattccagcctgggtgacagagcaagactctgcctcttaaaattaattaattcaggaaattgataaaaatataaaactaatcaataagtgtttattaatacaaacaaccatatattaggattaattactaataaacaaatgctatttattagtaattaatactaataaacacttattaattacctactccatgtacagtacaaaggtaaagggaatggtattaaatgtttgatacaaggcaataaaccattaaaaaacagaaaagaactagttcaagtttcaattttagatagatattccaaaagatctaagctgttaaaattacctccttcagccctatgttttaggcaagcaaaagtgctgttaatttaatattcattgtttatgattaatagaatattatctaacatttatgatatagcagttatatttgcataagctgttatatacagcatgctaaggtctcttgtattagcaatgtagacagtttctttatgtccttttcataatatgagcagtataattttattattttaaataactataagagtacatcatggtgactatggctcataacaatagattgtgtacttgaaaattgctaatagattttaagtcttctcacaagaaaaaaataaaataaaagtctatgatttatttgatacctagttcttggccaagaatctacctcccctcaataacaatactgttcctgtggaaaaataagatacctttaaagcaatcaattttatacatttatcaaaaatatttgaaaggaaaaatacttcaaaaggctcagaacaacaaacagaaaaacatctgccaagcactgcataatttaatacaacatgaatgcaagtgtaattaaagatattcaaaatttcttcaaaaaggttgttcatattattactttgacagcagatgattcctattcccatgctcacaccttcacttaagattagcacaaatttattttgtaaaatgcaatcaaatgctattatactcacgaaattgcctcttctctgttttctccccaagaaaagcagtgaccaaactgagaatcagcaaattcatgaagtccccctgcagcagcaacactgaaatatccccaaacattcttattgctgcggaaatttagctcctgaactgttcctgagctgggcttaaaaccctgttagagaataaagaatgagagaccatattatgtttcgaaggaagagaagatttatatattcattgtttaagttctctgttaatcacacacagaagcagagaagacacacaaaaatgataaaggccaagacccagtgccacagacccactgaagactctacagtgacttaagtgggattaagtaaccaatgaagcaacaaccatttacttatctgctctgagaaacctctatgtttcccactccagaggaagtcccaagatatttcagaagtatactttcagatactatcttaacattaaagttcattaaaaggaggtataaaccttttaagtgatgggttacctcatctggattttcactagtgatccgagcagcaataacatggccccttggacaaggaacgtgtgcagaatcttcaaaatcaatgggagaatcaccccagggagataccccatacatcatacggatatccttgattctatatagaggaatccccatggcaatctgaaaggtaataaaacacacatctttaatttttcagttacttcccttaaagtgtagaggctatcagataacctaaaatatttttatttttggagccactccctaaaacattctatttttataacctgtattctacaatcatcaactctaagttgcttgaaatacaatatatcactacagataagtagttagaatattctccacttctaaagaagtccccacattcctaatgcaacagacaccagttcccctgttgtcatttctccatcacgtaataagaatgaaaatatccaacagaggagtaaatgttaatagccatccaaaaacagacagctagaaagtcttaattgtgtcataattatctcttccatccctgcaaaccactggaggaagtaagtaaatctttagtctttaataggaacccagaaggtgttctcgatgtgggcaaatgttagataaaaataatatcaagccttatcattaactattactgctttccataatatttgtttcctgggctgagagaagacaataatattgacagcaagcactttacaaattataaaaatatatgtgtgctaccacactcttgtaaggaaaaacttcaaccactaatctctgatgcagaattatttcaataaagaacactagtaaaaaaacaaaaatgagtagggaataattataatacaaagttgtgaagtttactatagctaaataattgaataaagcatacattattaacatttatttctaaaacatgacacattatatcagatgtgtctggctagaaaaaataacattcctatgtctgtactacatcaggaaaaccaaaccacacatgcataacacatacagggtgaaagagaaatgaccattaggtgtgactcagataggaggtgcttttctcttatcacacactggttaaacccatttttcaggcctctctgacttttctaggctctgcaacccagatcagggagactcacctggagctgtgctgcagggagattgacatcagccaccatctctgtacaagggtgctctacctgcagccgaggattcaattccagaaagtagaagctgccatcctggctgtacaggtattccacagtcccagcactcacataacccaccattttggcaagtttcaccgcacactcaaagaagagagataagcaaacataagtatctcaccttatccaactgctagaccactacagcctctcactgactcaactgttcagtgtgtataagagccatcaaaagcttttagccacatgagagcacatttctgattattatacaatatccctggacaaggatgaaaaactcaatgaaaaatcgggagaaaagagcatttttcactttgcatcaaaagcaacctcaccccaccagacataaatgcatgcagacaaaaaaacatggggacagactcttgtccagtttccagtatttccaatatgctcctcttctttctagaaacatagctaactagttagagactagatttttttttttttttttgagacagagtctcactctgtctcctgggctggagtccagtggcacaatctcgtggctcactgcaaactctgcctcccgggttcaagtgattctcctgcctcagccccccaagtagctgagattacaggcatgcgccaccatgcctggctaatttttgtatttttggtagagatggggtttccccatgttggccagcctggtctcaaactcctgacctcaagtgatctactcgccttggcctaccaaagtgctgggattacaggcgtgagccaccatgcctggcctggttagtggctaagttttgacaaacaggacaccagcattggtaagtgatatgcataactcccaagtcatatatatatatatatatatatatatatatatatatttttttttttttggagatggagtctcgctttgtcacccacccaggatggagcacagtggcgcaatctcggctcactgtaacctccgcctctcggattcaagtgattctcctacctcagcctcctgagtagctgggatcacaggcacatgccaccatgtcaggctaatttttatatctttagtagagatgggttttcatcatgttggccaggctggtctcgaactcttgatctcaggtgatccgcccacctcagcctcctaaagtgctgggattataggcgtgagccacagcacccagccctaagtcatattttgaaaaggaaatgtctcattctctattcctggctttttccttcttattcattggaacatagtcatgatagtataagccaacttcaatcatgcaaatgagaacacactaagaacaccaagaaaagaaaggaaaagaaaagaaagaaaaagaaaagaaagaatgaacctgaatcccaagatggtctcgtggaataaaacacttccaccagccctgaaaagctcacctcagactaggatgggagagaaaaataaacttctatttttgggggggtccgctgtgttttttggacctttttgttatagcagtttaacctgtatcctaatcgatacaggaattattaagtgcaggtagaatgttgctgtttaaaaatattaaaatatgagatgctagcttagcaaaagggtagtgggtagcagagaaacagatactgcaggctggaaaggtgataatctccttgttgggataacacaacatttggtaaactgtttcctacaataacttgggatactgaccacacaccaactaaaccttaaaaaagatggtctgaaagggtcagagtgtcgaaaaagccaacttcttttgtatccccccaaacagaaaatgagattatcaccctgaagcaactcagtgtcaaagatcaaacgtgctgctttagtttcagctggccccaagatagccaatattaaatcaaggcaagagagataggctaagcacagaagccagtaaataatagaagaaaagtttctatatctagaagaaatctatgagtatgattaatccaacccaaagctgattgcaagcaaatagcccagaagcttagttaagtatttgaaggaattgtatttctaaacaaaccacaaacctggccttcaaaagcctgcgactgatgattgggatatttgtgccctcaatcctgcaccagcaggaagtgggttgtgaaagttctgccaaagaaggcatagtctccaaagcccaactcacagagaaaactgaatgaggaagaacttcccagaaaacaatgtcaggtgtcttgaaggacaatgaacaagggatttactcccttattgcacttctctggagtgtgcagtagcagaaccagggacagccaggtctaactgaggtagtattctattatatagcagggaatcattgcaattcctacctaaaaaggaggatttgataactgctatggaccaacgattgctatgtatttttcatttttccaaatgagagttatcctgttcctattccatcattgtatatgggtgtatggtgaaggcaggggatataatactgggtaaataacttgtattttgagtcactggcccatgaaaagccacaatacatatctaatggagaagaatatacatcatatagagatccggaatcacctccagtaataacccatccagttactagtaactggatggggcttcaggttgtcttccttggacaaaggctatgtgtgctctgaaagtaggaaaaaggataaagggataataggtagccagaggaacagactgaggcacagattatgaaatgccctccagtgacttttctctacttcatcattttaggaataaaatcgaaatttttgctgagcacatggtcacccagttagtgatcacaattcctaacatcctttgtgctaggtataattgtgtaactgaattttgtccagtggaatgtgagcagaagtgatgtatgtgacttcaagatcatgcttccatatgcttgccctccacatcccctgtctcttcctcccacaggccacaatgtgaacataatcttgtgtgagttagcttaatcatgaagatgacaatgtccaagagcaaagtttggcaaacttttttggtaaagagccagatagtaattattttcaattttgtgggccatatagcctctgtcacaactattcaattctaccattgtagtgataaagcagccataaataacacataaataaataagcatcattgtgttccaacaaaattttatttacaaaaacaggcaacaggtgagcaataaacctgtttctggtaacagctcatctctgaactatgatgaaagagaaatagaaacttacaccttgtttaagccaccgtattttgcttatttatttatttgttttgagatggggtcttgctctgtcacccaggttggagtgcagtagcatgatcaaggctcactgcagctttgacctcccagtgtcaagtgatcctcccacctcagcctcccaagcagctgagagtacagacgtgtgccatgacactcagctaatttttgtatttttagtagagatagggtttcaccatattgcccaggccggtctcgaattccagggctcaagtgatctgtccgccttagcctcccaaagtgctaggattacaggcaagagccaccatgcccggccaagccactgtattttgaaggcatctttattacagcagttcaagagtacatcctaatatatacacaacataggaaatagacctctaacacacatgaaatatattttgaagaatctattttgatgtagagactgggttaggactccagaaaagactatgttcaggcctctaaactatagttattccgaaggcatcgctcatgactttgagaaactactttctatacaaaaagatagaatgtgtgaactctgaagatatttagaggactttccaaaaacgataatagagttgattaaattcagctgaagacttgatgatactcaacccagcaaataaaactacctgattatgagcctcttaaaaaaatcaatcataagattaaaaattccaaaacatttctcttctttatccctgtatcctgaaatggtacgctgattttttttagaaagcgttaactacttttagaagcttgacatgttccttgacaattctcttagtgggagaacagtagaattttttttctctaagaaaaggatataattttattaattattcagaatcgttgcttaaaatgccattgttctcagattggtacatgaactgaatgaaaaatgttctatgtaagaaaacataaagtaagccttttaatatatgtacctgttccatgtgttcaaatactgctggagtagcaatagtagcaggtgcttcttcaataatcttctgatgcctgcgttgtacagagcaatcacgaccaaacaaagagatagcattgccatattggtccgctaagatctgcacctccagatgacgagattgtttggctagtctcatcacaaatatgggagatccaggaacttcagcttgaacctgtattagaaaagggggaaaaaaaaaaccaattcttaaattttaaactttttatctatcttgataagctactttgatttcaacaagcagatgtccagaagtgtcaggaaccatgttaatcagcagaaatacaaaactgaataaaatacagtccatgctgtcatctttaatatctttaagatgctgcattcttacataaccaatattaattgataaatatgaaaacatacgaacatctggtgcatcacaaaggtaaacaacaaaatatttgaaaacataggcacatacacaaatccaacaacagggcaaaatactgccatcctgtactctgtacaaccaaatgtacaacttgttccagacaagatactttcctggttcacattacatcatatatggtattgttgcagccaaaggactttcatctttagttttgaagaatattactgttggggacagaattctaaaatggtaactattttttttctcagcactttaaataatcccaatgattttcagctttcactgtttctactgagatgccaactgtcaatcttattgttactattttgaaagtaatctttattcctcagctggtttaagattttctctctttctgtcttttataggggggagggtggtagatttactctgataagcatagatgtggttctttgtatttgtcttgcttgaggctcatagtgctttttgaatctgtccttggtatcttttatctgttcaaagaaattcttagcttttctctcttcaaatatggcttctgcttcatcatttcttcaattattgtttctgctccattctctttctcttctcctctgagacttaaagtacatgatgttagaccatttcacataaccatatgtcttttatgctctgtatcttttttgctctgttttgccatgtagcaagtcatctcaaaactcagtggcttgcttagaacatcaaccttttatgatgttgttctcatctgggcagttcttcttctggtcttgcacttacatacatatcatcatctggtagcttgagtggggtagaatggtctcactcagatgtctggtgatttgtgctgactgctggctggtaggtctagggagcctcagctggaatcgttcatctccaatgcaggtggcttctcatcctgcagcaggctagactaggcttcttcagtgatgtgttccaagaggggaagaagctgtaaggcctcttgaggtctaggctttcgaatttatacatcactttggccacattctaatggtctaagcaagccacaaagccagctaagattcaaggggtagggaaaatagatgccacccctggaagggaggaacagcaaagtcacattgcaaagggtgtacatacaggaatgggaggagttattgtcgccatctcttgcaaacaacttactatgctctaccctatggccacaataattcacatacctcccacatgcaaaacagactcaccccctcccaagacccccaaagtctcatccaatcatggcattgggcttgacgtccattttctcatgagtcatgtccagaagaaaatgaggttccttgggtgcaactcctcaggtacagtttctcttgatccaaagacctgggaactaagaagacaagttatctggcccaacactcccaatatttatgatgatattgggaggggataactgcaaatgagactgctgttcaaagaggaggaaataggaggtacatagtagtcattggtccatagcaattctgaaatccagataggtacatgctgtcagattcccttactccagggtcaggaatgcttttcattttgttttgttttgttttgtttttcaggatctagtttggttccctgggagtaggtccttaatccatggcatcccctgctcctagctctgccctctgggctcctgactccactctctgagaaatccctctttttatttgaaatgacagctatttacagctgaatagctttctgtctgcttcctgctcattaaaaagtttaaggctcagaggtcacttttcattttgaactgtttctggccctttcagtcccttggtgcattcatcaacacaagtctcttgacaactttgtgggtttcctatgaatcatattggggttcaccgctcacccaaagagacacatccacaactcatgtctgcatagacctctctatactttgggcacgtcaggatgctgtgagacagtacccttaagatacttagggccaggcatggtggcttatgtctgtgatcccagcactttgggaggccaaggtgggaggatcatctgatgtcaggagttcgagaccagcctgagcaacatggtgaaacctcatctctagtcaaaacacaaaaactagccaggcattgtggtgggcacctgtaatcccaactactcgggaggctgagacaggagaatcacttgaacctgggaggtggaggttgcagtgagccgagatcgcgccactgcactccagcctgggcgacagagtgagactccctctcaagaaaacaaaaaaaaaaagatagttagaagcatgtttccagctgaaagcattaaaaaaaaaaaaaagatacttagaagcatctttctagctgaaagggtaatttattagctactaccttaaagatttctgaggccttaaagtcacaggcactcttgacttggtctttactctgaggcattttttactttgcaaatcttttgccagctggagagactcgggatgagaaacaattctattttcaacaagttctgggtcctttacatttctgtaaattctgcttgtaagcaaaacatcttctttagcttacctctcttttacagttttttagcataagcaactagaagcactccacagatactttaaacacttgtagagagctccttaaccagatccatgacttcattaaatatattatttgtcttccaagttacctcagataacatttttttgccaattgttccattattacagaacatggatcttttttccagactccagtaacaattactacactgcttttccagcctcccttaacaattcatcattcttccagtcttcattaacatcctcctcaccaatgttcagcctacacctatgagccagttttaaagtcaatgtcttacgttttacttttctgttatggcaacatcataccgttaggtatcaatttctgtgtcaattatccattgatacctaacaaactaccaaaatcttagtgacttggtatagcaaccattttattttatttgctcatgagtgtgtggatcagcattttgaactgggcacaactggcagttctgatcttgcctggagtaattcatgcagctatagtcatctggcagctcaactggggttagatggtcaaatatggtctcatttacatgtctcaaatgtggtgctgctgactgtcctagtaggactaggaggccttagctgggacaactcatctctgctcatgtgacctctccttctctagtaggctagaatgggctcttcacatggtagtctgagggcttgctccaagacagcaagagcaacaactacaaaaccattgcaaataatttctcacattgctctatgtttttcatccttttgtctttcttcatgcttcagtctgaatttccttctgatctactcaccagtcgttaattatttatctttttctagatttttttgttttgtcacccaggctggaatgcagtggcatgaccatagctcaaggcagcctcaaactcctgggctcaagggattctcccatctcagtctccagtgccagttactgattctcttcaactgcatctaatatgctataattttaaactcctatattgacttcttcttcttcttctttttttttttttttaagacaatgtcttgctctgtcacccagactggagtgcagtggcacaatctcagctcactgcagcctctgtctcctgggttcaagtgattctcccacctcagccacccaagtagctgggattacaggcatgtgccaccaggcccagctaatttttgtatttttagtagagatggggtttcatcatgttggccaggctggtcttgaacccctgatattgacttcttaattttagttattgcattttcagttctagaacttttgtttcttctttatgatttccagttctctaccaaaattctcaatcttgcctttactttccttgaatatattacgcagaattactttaaagtccttgtctgataatctcattatataaaccctctgtgggtctgtttctactgttttgttcttcttggttttcaatcatctaattttgtatgcctattttcaattgagtggttgataagctgtaagaaaaattaatagaaataattttaagttctggatgttatctttctctggaaaggatttacatttgcttcctgcaggtgtctagaagcactagcaatcctaaaacatcttgcttaaatcagaggttgaatgttttgaagccaagatttagtccctgtgagggctagtctatttccagttcaccctttctcccatgatgtagtcagtccttaaagatcctaacctaaaatgtgggaggttttccagggcacccctccccaggaagccctcttagtcttttaagactgttgaaaacttatcagcctttctactatcttgaactagaagatatatctaggggaaaagtagcctcatatgtcaggctcacatctctgggtttcctttttctcttgtatgttagccccataattcttcactgtcttgaatggtctctaatgccgtaaaatgtaatatatctatatctatatctatctatctatatatatatatatatatatatatctggttcagcttttctagtttgttcccaatgggaggattagtttattcagccaactagtattgaaacttaaggactttcacagaaaaccttcccttagtgttttaagacttttccactatttgattccataagtaatgagtagttttgaaatgtctgtaagagttaacattaattaacatgccttttttttctttttgcttctaagagcagtcttttttctctagactctctgagtcactgatctacctatgaaattagaattcaatgaaaaaaatgtaaaaaaaaaaaaaaaaaacccaaggtaatattcaatttctgacacttaaaataggataatgtagcaaaacaataccttatttattgatttatttattttacaattttttgtagagatagagtctcactttatcttccagactgatctcaaatttctggcttcaggcaatgctcccgctttagactcccaaagtgctaggattataggcataagccaccaatcctggccaagacaacacctttatcacttcctttatctagtacagatgctctttgacttacaataaggttatgtcccaataaacccaacataagttgaaaatgttctaagtcaaaattgcatttaatatacctaacctaatgaacaccatagattagtctagcctacctcaaatgtgcttaaaacacattagcctacagttgggcaaaatcttctaacacaaagcctatattataataaagtgttgactatctcatgtagtttactgaatgttgtactgaaagtgaaaaacaatagctgtatgggcactcaaagtaagatttatactgaatgcattatcacttgcacagtattgtaaagttgtttgtttgttgattgtaagttgaaattttaagttggggaccacctgtatatgaaatcatggaagacccagctcataagactttccttttaactcttaacagtgaagcaaggagtttgctgctaagtgttttaagggaaaaaaaaaaaaaaaaaaagcgaaataaaaggtagcatggcacactagtaaaagaagtgcaaagtagaagatgatgaggaaactatgaaaaagagggaagctaggagagtgaaaagagcagacttctgtcccaattttccattttttgacaaatcttttactatgtattggtaggaggaaaaaaagtgagttaaatatgtgagggtaactctgaggacagaacaaaaagagacccctgtctcccttttctctttctgtttaagattctaaaaagacatcacttctttggtcgtctccgcaaccaatgtatagtatggccacatcaacttggctgcaaagcagagggtaaggcaaagagagatcctacatcgagctttcctgagtcactctcagttcctatatactgtaggcctgccatagggttcctgtgccagggtgtggtggccatgcaacacgggctagggtatagagtgctgggacagcagggtagatgagacatatgatagaaactcagaggtctctaggcaatgtgaactaaagtgagaaaaagtcaatcagagagcctgggcctggccaagccaagagcaaccatatcagtatcataccaccatatcacatatgacctacaaagtcagcagaacaggggcacaaaaatacagaaaggtattgatttttctttgtcattatgaggtcctataagccatacgcaccatgtaggaaagagctatctgacaaactgagcacgtttatataagacagaataactctactgtttgaattacctaattaaataaaacttaaaattgagttggacatttcattaaccttttttctctgctaatatgcaggtagaaactagagagaaagacagttagctatagacaaaattaaaaattaaatattttctgggcatccaaattatagtatgagttaaatcatatatctctgatatacatgttagttcaaacaaacaaaaacagcttatactctacctgtctgaagagattagggaagtcatctgcattgttgacttttctaattcccttccctcctcctccctctgaggccttgatcattactggatatccaacttcctcagctgccttcaaaaagaaagaaaaaaaaaatagaagaaacagtgttattaccagggaaggagaaaactggcatttttctccctttaagaatgcagtcatttagtaattctaaatacaataaaatagaaagatcttcaagatacactatgaaaaaataaatagtagaacaatatttgtagtattaggttgaaccaaaagaaattgcctttttcatagatttaaaaaaatgactgaatataggcaatttcttatggttcaatctaaagtaatgtcacatgggtcaaaaacaaaattatatatgcattcatacacccacacatgtaagtgcaaagaagtgaagtccagagtacataccagcaatgatttagaaaagaatgggtccgggcacagtggctaacgcctgtaatcacagcactttgggaggccaaggcgggcggatcacctgaggtcgggagttcaagaccagcctgaccaacatggagaaaccccgtctctactaaaaatacaaaattagctgggtgtgatggcgcatgcctgtaatcccagctacttgggaggctgaggcaggagaatcgcttgaacctgggaggtggaggttgcagtgagccaagatcacgccattgcactccagcctgggcaacaagagcgaaactccatctcaaaaaaaacaaaaacaaaaaacaaagaaagatgcgtggatataaaactttcctttttcactgtatgtatttctgcattattggaatttcttgcttatagtatgcaggcatacatgtattacaattaaaaaaaaaaaagacataaggagttcacttaaaataagctgaagtggggttgggcgtagtggctcgtgcctgtaatcccaacactttgagaggctgaggcaggtggatcacctgaggtcaggagttcgagaccagcctggccaacatggtgaaacccctggccctattaaaaatacaaaaaattagctgggcgtggtactgcatgcctataatcccagctactcgggaggctgcggcacgagaattgcttgaacctgagaggcaaaggttgcaatgagccaagatcgtgccaatgcattccagcttgggcaacaaagtgagaccctgtttcaataaaataaccaagtcattcctttgtcaaaatattccagtcttttaaggttttgctacattataagaatatctttaaaatgtatcaccaggcctggcccagtgcttcacacctgtaatcccagcactttgggaggccaaagtgggtggatcacttgaggtcaggagttggagaccagccagcccaacttggtgaaaccctgtctgcactaaaaatacaaaaattagctgggcatggtggcggtaacctgtaatcacagccacttggaggctgaggcaggagaatcacttgaatctgggaagtggaggttgcggtgagccaagatggcatcactgtactccagcctgggcaacagagtgagactccaacccaaaaaaataaaataaaataagtatcacccagaaaaagaacatttcaatttttaatctatgtcaatcgattacttaatgaatgaaaatcttttatgcacagtctcaccttttctaatgtttctttattcttttctatgctcatataaacagaattagtatgatgaactcaattgctgagtgatagatgatcaaagagatagcttaaaaaaaagagaaagacttaaaaaaaaaagggggtatcccataggaggtcagtaagtaagaaggtaggccttttaaaaatatatgaaagctttagtcacaggtcacccattaaaaatattttggaagaattttaacactttaatataatgttaagtaaggagcggggaggtagaaggacaaaaaaatattaagtagaaaaaagtattatgattaccaacacaatacaaatagtaagacccaaaacttataattatcataattataagtataggaatctattaataaagatttgtatatgatataaatctatgagttgaaaagggataaaaaaatgaataggttaatgggcattatctttggatggtgtgtttgcatgtggctttatcatcatctttggcttttcaaattttctaccagaaaatgctgtttataattataaccagaaaaaataaaaaagaatgttagtcgataagcaaaatagctagaatagctagttccttacaaagagcttctactcttttgcaaattataacaaacaaaataaagcatttgaaattcaattagaaatattaattcttcttattaaggagattacaggatgtttaacttaaaatgcaaacaatacaacaaaattatttgaacattcagcatccctcttgaatttacatgacacaagtcaaactcaagcagtgtatttttctacaatagcctctttcattatctttcattatacctggaagcataaccaacactttaaactatttataaaagtgaaaggggaacaaattggagggaactgtaaggaaagaaaaggtaatgttggggaaaggatctccttttgcctaggttcacatttctacatggatagacaataattaagagtaacactttcagtctttcttggttcactcccttgctcctccccaagggaaaaataataaattatgtgattggtcaacttggaaggagggactgaatatgcatagctcagccttttcccctttgggatcagcccactgcacaggacatatgctctttgtcagctctcagccatacactaagctgaattaagctctctctctctgtcgagggaaatctgtggtcattcagcactgccagtaaccagtgggtgagtgagcctgcttaactctggtgtttagtttacaaatctgaatgttgctacacacttaagccattttcatcaacatctctgttcataataaagctgactgtttgatctctgcttcctggcttcttggttctgaattcaaccagtagaaaaagtatgttgtttgttgtccccgccctcacacactaacaggtggtagagagagagagaatcagcacctccttaaaactctgacttaatcacctaagaaatgttctgtccagatgagcagcctgcttcaaaatgaatttagattgtttacatttaaagtcacttcctcaatctgtactttttaaaggcaaaagacttatgcaatctaaagagaaaccagcgtattctatactttcaaactacacctcctggtcttacatccctaacaccaccttgggtatatatcacgagccaggctcccaatctccacatttgtgactataactggtcagctgaaaggtatcactccctggagttagtaacctacctgtagcccatcatccacatctttcacataacctttttcatatagctcctggggaacatttaagatacgttttgaaaaatcattttcctgccagtccacacgaagacctgcaacagacaatagcaacttagggcaattacaagatcttctgctcttgtcaattttctgctctgcattctttgaaatgctatcatatttacccaaaactgagagtggatgggagaaagaaggatgccataaaaccctgatcagtccttggggttaacaggatttagccacagcatgacccggcaacttgggttcttaacgctggcaaaagccagccgaactaacagggagcaacttataaaaatgcaaagacgtacaagatcaaaacaaacaaaaaaagaacatagcatacttctcacagcaactcagcaggcaaaataccttcaaactgtgtgttcaggcctgctccagggccaagaggtctgggaaataattcaatctttatgagcccttggaaatagaaatggcggttttattggcctcagcagagtcatgattccatgctctctgaacgtccctgtactcagccataaggggaacactatagcctctccattcaaacaagaacaaattcaaccttttattttaaactatttgacccagcagatctggagaggatattgcaatctccctggagagccagagtaacaagggttcaaatctgttcagcctcaagacagtggtcattcccatttaaaagaggttttagtgtatgtctgttcccagtgcttgagtacttaagaaaaaaaaaaaaaaggttcatattgttatcagctataataattcacatggaactgtttaagggatgtgttgagaataaatcactttttgaaaattcttgcccctctggcatgcctggaagaaaggttaattactgacctcattttctgcatcaagggcaactgaggttgaatggtttttaaacagtcaaatcaaatcatcaatagattgtgggttgatatcaagaaaacattggcgccaggcgcggtggctcatgcctgtaatcccagcactttgggaggccaaggcaggtagatcacaaggtcaggagttcaacaccagcctggccaagatggtgaaagcctgtctctacaaaaaaatacaaaaattagccgggtgtggtggcgggtgcctgtaatcccagctactcgggaggctgaggcagagaattgcttgaacccggaaggtggaggatgcagtaagccaagatcatgccactgcactccagcctgggcaacagagtgagactccaactcaaaaaaaaaaaaaaaaaaagaaaaaaaaagaaaaaaaacattggcaaggaaacatttgagtaagtgggttttaggtttttcctagtgatccaggctactcccaggcaggtctgaagacccaattccccctgggaagcccacctctgaggaagattctagcctacccagagtacatctaaacccacaaaaccatatatatgttttcccagagtttttctaagttaactcacaagatcactccagatcacaatttagcatctgtgtacctggaactaaatttatattactaaaagaatcacaggtgtattaattaagctaggagctacaaggtaccattaatcaaccagtattccatttcttgtcaagtataccaatactttttcaaaagaggtaagtcccaaatatcctactgagctattctgtacttcaagatacaaacaagaattcagttcttaccactgccgctccagggaagagttgggatacctgcagtttgagccactatggaagatgcaatcttatcccctaaagcccacatggcctggcttggaggacctaaaaacgaaacaggaaaagaatcctgactgtaaccccttggcctcatttctggcacatgtagttgccttgtattatagctatttatgtatttgtcttgtcctccccccacccctcacatatcaaggagatcataaattatggggactattatgctttgacttatctttgtaccatctgtaaaacctaatgtagtaagctttttgtgcagagtgagagctcaatatatataaatgtatgctgaattaaatttttgacaaatctagctataatgttatcattcttcatgatccaacttcaccagatcaataaagtcttcttttttaagtcaatatcctgaaataaggactttaaagttttaggattcaagtctgaaatagtatacgctctttggtcttaggggaacccaaaaaggagacatctttaaaaaggtttacaaaacataatcttcattgtttaaggtctctgagacagagagaaaaatactttgagctatataacctctgtttttctctctggtataatgacagcagaaaagtcagaagaagtatctctcacttgtaggagtatcacctatatgcttaaatgcacaggtgctgattcatatttaagggcacactgccaaggcatcctgagtattcaattatcttcactatctaaaaacaggtcattttcccacatgctttcttaaggttagctgcaaagttttaaaaggtcagagttttagaaaccaaagccttctccatatctccatatctgacccagggacagaaaacaaaatcaagatgaagtgagataagcaaaaaatgaaaaaaaagaaagaaatgaagagggttactctgagagttagtaatagattgagggaaaaaaaaagagagagagagcccagcacatgttaaacagaaaatcagactatagagtaaaatgtgggcaaaattgacagaaagaaacagaaagacggacaatatgtcagaacagcttacccatgaaggcaatgccatttttcaagagaagttccggtagtttgggattctcagaagcatgaccccagccagcccacactgcctgcaagggaatacaatataattcattcttaaaattcatacaaaacccccacaaactgcaagagtctctatccaggctggccctgtttcttgaggtacagtagttccacagcagcctaatgcttaattcagcttctatgcttgattgttggcaaactctttacagagtaacaataagtagtccattgtggcaagatttctgaaggggtcaaaaccaagttgaaattgatattaagatccagttatacttgttgctctttaggaaactcaattcatagcctaggctgtaaagggcgttttctagaaaaactggctatgtttcacatattcaattactatggccacgccattacatcattattgattacactgccatctaagtttagagttttttcctctttgggctttaaggtacctaccctaaacttactaacacaatgtgacagggaagaaacagcctacttctttaatataccaccatcctttaggctaatattccacaacaaacaggtaatttttactggctcaaaggtgagatacctagaataaataatctctgaaagatgcttccaaaccttctgtttgtattacgtttactttatttttagccattccattatttccatctttcttttccttatttggtttagttatcccatacacaggcatttaataattttcgaaaatgatgctttacaaaaatgttcttctctagatatccccttgtgcctaactataaaatggctgaatttggttttaaaggacacattggcatctcttacttgtactgggatccttttagcaatatcaagaattaattccacatttgcatagttgttgttgtttggtcctccaggcactggcacatagtgatctgccatcttaatgtattctgaaaatgcaagcgaattaatagagaacacatgatttttttttccagaaatataattgcacagcaaaactacgtaaaggtcagggactatcataagtaaccacaggacaaacagcattagtaggataatttccaggaccatttagttcgaggctcttagtttgttaagtcacaagcactaatacgagttaatcccatatttagaagctcttatagtaaaatagcaattctccaacatttcactatgtaatctttctgaggaatctttatgacttctatatcaaggctgatgtgtctgtcagttaggggcccaagtgcaattactctattccgagaaaaagttctagtcctgacatcctttgtctttaactggtactggacctagagaaagcccttttcctggtacagagcttgacagaatggagaaagataggagagcctgaatggcttgcaaactggctaaacaagaaaggttagttacaggagtgtctggaaagagtttatctggaatactgagggtaacaggtatttgtaagaaactttagaaagataaccactttctcatatatatttgttgtacagtattccctttcaaatttgtcacctaacatctctattttcctattctggcaatgacacctgtaacagaagagctaccacgtgtagggactgtaactagcactttgtatatatattatctcatttaattctctcatcaacccaatatgtgacagaaaatgatggcttggaggagttaagtaacttcctcaaagttcatttccaccatttataaatttattttagctttcaaatttcaactcaagcatccaccattatttactaataataaatttattttatcttgttcttttttaaaaatgtaagttccaggatacatgtgcaggacatccaggtttgttacataggtaaacgtgtgccatggtggtttgctgtacctatcaacccatcacctaggtattaagccccacatgcactggtaaaggacaggaacagacagacacttctcaaaagaagacatttatgcggccaacaaacatattttaaaaaaaacctcaacatcagtgatcattagagaaatgcaaatcaaaaccataatgagatatcatctcatgccagtcagaatggtgattatcttgttcttatttctaaaagattttaagtcccttctaaaaaaaattctactaaaaaaaattccgctagaatttcttcaaaattaaaataggcttattgttctctttgattataggaaggaaagcatgcaaattattaaacaatgttagataatacaacagaatataacaatactatattttaaaagtgaaaattggccaggcgcagtggctcacgcctgtaatcctagcattttgggaggctgaggtgggcggatcacgaggtcaggagatggagaccatcctggctaacatggtgaaaccccatctctactaaaaatacaaaaaattagccggggatggtggcacaagcctgtagtcccaccacagacagagtgaggctgagggaggctgaggcaggagaatcgcttgaacctgggaggcagaggttgcagtaagctgagatcacgccactgcaccaacctgggtgacagagcaagactccgtctaaaaaaaaaaaaaaaaaattagctgggcctggtggtgggcacctgtaatcccagccactcgggaggctgaggcatgagagtcgcttgaacccaggaggcagaggttgcagtgagccgagattgcgccactgcactccagcctgggggacagagtgagactctcacctattgtcccacctcaaagacaaccagtttatgctttactgtacataaatatatatatttttggtatatatatgtttaatattttttatggatacctaatatttcaatagcctatataattcatttgactactaacttatcaatggaagtacagattatgtataatttgaaaaataataaaataatgtgtgtctctgtacggctgtccaattatatccacagatatgttactagcaataaaactattgggtcaaaaggtattcacattttcagactctcactagcaacatgggtaccaaatactctcacctatgttaggtattatcaatgtcttcaattttgtgagttttgtaagttaaaaaaaaatctttagtattgttttggtttagatttcttttttgtttgtttgtttgtttttgagaccagatctcactctgacacccagactggaatgcagtggcatggtcatggctcactgcgacctcgacctcccgggctaaagtgattctcccacctcagcctccggagtagctgagactaccggcatgcgcctctatgcccagctaatttttgcattttttgtagagacaatttcaccacatggtccaggctgaccttgaactcctgggttcaagtgatccgcctgccttggcctcccaaagtgctgagattacaggcgtaaaccaccatgcctggccctccatgctttttatcaataaggtataatctcttaatcttaaggtagagtatcttcacagataacatgaagaataatatggtatcaaggatttgcatcaaaataattgtgcacggggttaagaatatagatgaaactagattcgccataagttgataattattgatattgcatgacaggtagatgggaagggattcattatactcttcaacttttacatagttaacacacacacacacacacacacacacacacacacacaccccaaaaaacacattcatttaaaatgcaaatccttagatgtccaacacacacacatactctccttaaaagacaaagtctgtgcttttgaggatggaaaacaaggtcccccttggcaaatactacatcacatcttgtagccatccgtaatttctagaaaaccacttgtgtcatacctttatgcatttgcaatgctgttctttctgtctggtacacctttctctccccccaattgcttcactaactcttactcattcttggttagacataatctctttcagaaagctgtctttctctctttttttttttttttttcattgagactgagtctcgctttgtggcccaggctggaatgcagtggcacgatctcagctcaccacaacctcctcctcctgggttcatgcgattctcctgcctcagcttccgagtagctggatttacgggcaccagcaccatgcccagctcatttttgtatttttagtagagatggggtttcatcatgttgaccaggctggtcccaaactcctgacctcaagtgatccacccgcttgagcatcccaaagtgctgggattacaggcatgagccaccacactcagcctaagaaagctttctcttaagcctgcccccaagaattagatgtctcatctctgtgttctcaccggaccctgtgcatgtttcttttatagcacttacctcattgtattgaaatcatttgtttcctagaacaagatcacatcttattcaactgtcagtctccatgttaagtgaatgaataaatgaattaattggagtaccaggtagaaatgaatgaggaaaaagaaaccggaccgggcgcagtggcttacacctgtaatcctagtactttgggaggccgaggcaggtggatcacaaggtcaagataccgagaccatcctggccaacatggtgaaaccctgtctgtactaaaaatacaaaaattagctgggcatggtggcacacacctgtagtcccagctacttgggaggctgagacagaagaattgcatgaacccaggaggcggaggttgcagtgagctgagtttgcaccactgcactgcagcctggtgacacagcaagactccctctcaaaagaaaaaagaaaaaaaccacgcaagttaatctgtatttattatagatgatctcatctttacaattatccagtgaattagacattaggatcttccttttataagtatgaaacttgtggctcagagatgtgaaagtgtgcatctaaatgatttcatataataacatgatatagtttgaatgtatgtccctcaccaaatatcatattgaattgtaatccccagtctcggaaatggggcctggtaggaggtgtttggatcatgagggcagctccctcatgaatggcttgggccatctccttgatgatacgtgagttctcactctaagttcacatgagatctggttgtttaaaagtgtgtggcaccctccccacaattctctgtgttgttcctgctctggctatgtgatgtgcctactcccccttcatcttcccccagtaagtgtcctgaggcctccccagaagcagagcagatgccagcaccatgcttcctgtaaagcctgtagaattgtgagccaattaaacctcttttctttacaaattacgcagcctcaggtatttctttatagcaatgcaagaatgatctaatatataacatttgctttctaataaattggtgtcttctcaatttctaaataagatgatataataacctttctttcttaggaataatcataataccattgtctcaacaaagaaaaaacatatgcagactaaaataagtataaaaggatagctctttttcgcagcttcctaggagtaaaagataaaaaaaagtaaaaaaacatagctcttcacattatctgtgggtactctaccttaagagattataccttagtgatagaaggtatggagaagaaagactagtcatatctttcagctataccaacagtctttatctacaactatcagacagagaaccatctgagtaaaaagaatatgtagccgaatttacagagtgaaacacacttcggtcccaaaaggtctctccctcaggaagagaaaaaaaaaatcttaacccaaagtttttctataattcaatataacgcataaggaaaaaacagcatttccttctaaatctttccacttacgcattccaaagaatgtggcatagcaaatatttaacactgaaaaaggcatacacttgaaagcccaaatcaacacttttgttaaatttcttcctacttatccctaggacacaggaatctgtatcgaggttgactatagtgcaatcatttttatatgtctattactgacacattttaaacagaaattattttaaaaggattttacttggaagtcctatgtttgggaatccccctaagttaacattctcctacttaaaggctgtgctgttccatgttttagttttgagagtgatgctttcataatgctaataactcacctgcattggctttaaggtcttcaggtgtgaccatgacaacgaatctaattgcacgttcatttcgaaacatttcataagaccacctacggatagaccgcatgcatttcactgctgcaatgccattgttagcaataagaacctgggagggggaaggagatgggaatgggaagaaaaggcagaaaaaagcaacaatggaggaaaagagatgagagaatttttacatatctatctttctgtgtaaaagtcatactttcaaccaagaattcttgttactggtccagactgttagaaactggcttccccaaggccaagcagtatctttaaatgttaactaagcaaatacttgagtatgtgccagctaaaacatactcctttctaacttcatttatttgaagggaaaagtcacaattacttaaatctgtgactttgtgaattattctaccatactaccatattgtgggtatggtatattatgaaatcaggaatgggggaaggccaaccagtgcagtgccatgcactcttctctgttgcaataaaatgaggtacagagcactgaacatgtttaaaaaccctggtattagttacttttctccaaaatactgaactccaataccttagaattgtagagaatgcctcagaaagaatggtcactgttgtagaaaaatagaataatcctgagactttctgtaaacaaacctttcgtctccttacctatcttgcagtcatgcctctaaggataacacagactaatagacacataatctgtctttattggaagactaataaaaggatgctgatgaagtaatacttttaggagtggaaatacaggtccccatcctttaatcttttaatcactggaagctatttcagccaagtcatcctctcagctctgacatggtttagacaaaagtgacacggaattacatttcaaaatacctggaatctctaagtatatcatgtggtatattcccttgaaacatctcaaatacttggtggaagccagtaagtcacagtgtatcaaactctttaagccttctcttctgaaactctctctactcccttagctttcaaaccagtgctgtggcatattatctccccaccagcacccacaagctaatcaattcttcataccctgtcagatcagtgcagccccaccctgtaaaaccacaagatctttcaaaaacatgttttgtttgagacagggtccctctgtcgcccacgttggagtgcagtggcacaatccatagctcactgcaaccttgaactcctgggctcaagtgatccttccattttagccccccaagttgctgggactcaaaaataactttatgagcactattttaactccttaattagctatgattaaattatctgtggtaaatacatattataggaaaacagtgaaattatattaataggatgctagggaggcagaaaggctaaaattcacataaagaggcaaagcctctgagaaactaaatatcaattgggagcaaatctagacaacaaatctaggcaagcattaaatcctaagtgcttttgacaaaataattcagcaagttacaacttaccttctcaatcactttatttcccccaaagcgagtaacaaattctgctggagaagccacagtgaaatctcgttgagaatctattttctttctgtctcggccctgctttactaggtgcaagccagacatgctggacctataaaaatacagaagccataaaaacaccacctatattttctggagacctgcttttcactaccatacccataacagtactttcacaactgcatcctgtgaagactgcatgctggcaggtcacgtacttttcaaataaaagagagaaaagaaaatgatcttgcttgtggaaatttaaggaaaaaaaagcgtttctgaataataaaagataatatcaaggtttaccagcagatgccatcacaaagagataggcaaaggataaatggtagaaataatagactcagagaccgttaaagccaaaaaacaagttaccagggttgtttctggatcacgactctggtgtgcagatgaccttcacctctgtatctctgacttctatctttcttctgagctataactccacattttaaaactgcctactaaatgttttacctgggtatctcctaggtatttcaaaatcaacaactccaaaacaaaattctttacaaggcagcataatatgccatatttaatcagttttaaggttctacttcttttctttttactttaaaaaaatctcctaggccgggtgcagtggctcatgcctgtaatcccagcactttgggaggctgagatgagaggatggcttgagaccaggaattcgagaccagcctaggcaacatggcaaaaccctgtctataaaaaaaatacaaaaattagctggcacagtcgtgtgttcctgtagccccagttacttggggtggggggtggggggcgcagctgaggcagataaattgcttgggcacgtgtggttgaggctgcagtaagtcatagtcatgctactgcactctagcctgggtaacagaatgagatgggtgtctcaaaaaaaaaatctgaaattggtatgtattttacaattgatgccttattaaattggcagtactgtttttgttgttgttttgagccagagtctcactctgtcgcccaggttggaatgcactggccagatctcaactcactacaaccttcgactcccaggttcaagcgatgctcctgcctcagcctgcagagtagctgagactgtaggcgcgccaccacacctggctaatttttgtatttttagtagagacaaggtttcgccatgttgaccaggctggtctcgaactcctgacctcaggtgatccgcccacctcggccttccaaagtgttgtgattacaggcatgagccaccgcgcctggctggcagtactgtattttttcttagtggtacataaaataacagtgtttctaacaatcaatggcaccttggattagacaaaatatgatagtggaaacagcacaggcctgggtttacattccagatctgtccacttaaatgatcttttgcaaataatttaaccttttcagcttcagtgttctctttgtaaaatatgcatgatatttactgtcctggttatttacctattgtctctcagctccaaacctacccttttatgctgtgctctgtgacaatggggccaagattctgcaaacttcatttccaagactcctttgctagctccttcctgttctgttcaccaaaccggaaggcagaaaggtaagaaaagggccttccttcctatttcccagctgttatcagtattgctccagctgtaacagaaacttaattccagtctctagcttctttcaacagtctggtgaaaagccatagaggtaccagcagcagtgggttgtggctctttggcagtcagaatatcaaccttgccatgctcactcatcctctggacctcactgcctgggcctatcaatcacctgtcaggccaaggatctgagtaccagctacccaaagcttatgcccagaggtccaggcaccagccctccaggagatctccaccaagctcctagttctggtaacactacctccccttttgttctcccagacttagaggtgatagctacttcctctagttattaactctggggtacctcagcatgccttttttgttgttgttcttttattcttctaacacccaattatgcaattctcgctattgaatgttctctgtttataacacctactacaatttattttccttgtgactgcaccttgactgatagaccctccaaaagagtgttcagaggattaaataagatagtggacataagctcctttgtacaccgtttgatagacagctgttttcttttcctattcccaccttttcttcccttcccctacaatttaaacttgatggggcagtaaggtgtcttttcaaaataagaaggtatgattaaaatcttcccacatgcagcacaatatctagctttctgtgcacatatagttttacatatacatacataaataagaccagtctttctttcttctctgagtgtctctatgcataaaactcaatgagtgggcattttccctatacttcacatgacttagtgtggctcttaacttgcaaaaccaccacctacgggagtataacaagaagggacaaggccaggcatggtggctcacacctgtaatcccagcactttgggaggccaaggcaggcggatcacttgaggccaggagttctagaccagcttggccaacatggcgaaaccacgtctctactaaaaaaaaaaaaaaaaaaaaaccaaatatccaggcatggtggtgcacgtctgtaatcccagctactcaggaggctgaggtgggagaatcacttgaacccagggggcggaggttgcagtgagcagagatcaagccactgccctccagcctgggcgacagagcgagactctgtctcaaaaacaaaaagacaaaaaaaaaaaaacaagaagggacagttcagagtctagcagctactttgcctactagacttaaggacagacataacaaaggctatgcactctgctgttggcactcaatataaaatgctctgtacccttcttagagactgacatttcaagctggtcaatctattaaaattttcttcatccttttctatccaggtatttagttatactgcatctggactggaactttaaagttaagaggcaccttatagaaaaagaggcccacaaggagaatgatttgtctaaggtcacaaaggaagtctgtagcatatatagaccagaaaaccaggtttcatggtcatttcaatgttcttccaattacactatgcaacatatctaatgataataaacaccagaggtctaaaaacagtgccagtgtacatgttttgtttcatttttttaatcacttcatttttctttcatacattctttttaatttttttattattgcatgtatttttaaataaataaaaattaccttcctgtccttaactttgtcatgaacctatttcttttgggccccaagtccatggatcattatcagtgtatcagactgagcaataacatgaatgaatctcaaaaacctcatgttcagagaaggaaaccagacacaaaaaagtatataccatatgactccatttatatgacaaggataactaatctacagtgcagaacacgaatcagtgggctggggctgtgggaaccgactgcaagggagtatgggaatgatggaaacgttctatatcttgatctcatagtaatggttacatgggtagatatatgtgttaaaaccatcaaactacataattttaaaaggtgaacttggcctggtacattggttcacacgtgtaaacccagcactctgggagggcaaggcagaaggattgcttgagcccaggagttcaagaccagcctgggcaacatagaaagagctcatctatacaaaaaaatcaaaaaattagccggccttggtggcacacgcctatagtcccagctacttaggaggctgaggtgggagaatcacttgagccaggaagactaggctgcagtaagctatgatcacaccactgcactccagcctaggtgacagagtgagatcctgcccccgctccaccaaaaaaaaagggtaaactttactgtacttaaattatacctcaacaaacctgacttttgaaaatactcatttacctgccaggcatggtggctcccgcctgtaatcccagcactttgggaggctgaggcggatggatcacttgaggtcaggagttcgagaccagcctaaccaatatggtgaaaccccgtctctactaaaattacaaaaattagccagacgtggtggcaggcgcctgtagtcccagctacttgggaggctgagcaggagaatcgcttgaacccaggagacagaggttgcagtgagccaagatcacgccactgcactctagcctgggtgacagagttagactccatctcaaaaaaaaaacaaaaaacaaaaaaatcatttaactgtccacataaaacaggtatatctggctgtaaattattcctcagtaaagttggcttttaaagaactgttactaatggtattgaaaggtaacacagagaataaggctaaggaagtacccacaccttgaaaatcagcaactgtaagtatggcacaatcaaacatttcttcatctgtcctcattatcttcaaccctctaggcacctccacttcatatcccacgagtatttcaaagtctgaggatacaaaaatgtcaatcaaaatgcaaactaggactgatcttcttaggaacttccatttttccattaccccatatacatttagatacctaaccaataccatgtgctctccggcagtaatataatctactctattacagcttggctttctcaacaacaggaatccaccactgcattatagtatttttgtcagtactactccaattcattcttcaaaatgcaactaaactgtcagtgctcccagtgagcctttgctgatggggatccttccaacttcaccccttaaggaggtaggtaactgagcttcctctgtgccacaccagaacatgcacttacatctttcctcccaatcacactggactgttacatgagcttaacacatctgttttccctgataaatagtgtgtgttccttgaggtcagatactcttattcatcccttgaggtcagagattcttatttattgctgtatctccagcaccaaagggtacctggcacagatagaagctgttcaaacatctttgggttttttttttagacagagtctcactctgtcacccaggctggagtgcagtggtccaatctcggcttattgcaacctccgcctcccaggttcaagcgattcttgtgcctcagcctcccaagtagctggaattacaggcatgtgccaccacgctcgactaattttttctatttttagcacagacggggtttcaccatgttggccaggctggtctcaacttcctggtctcaagtgatctgcctgcctcagccttccaaaatgctgggattacaagtgtgagccaccatacctagcctgctcaaacatttttgaatggtgattattatttattaattattgacaactacacaaaataacactatttctgagtactcgctatgggacagacactatgctaagctcttcacatgcactggcatattaatcctcgcaataatgctatgatgtttgagcaccattttacaagtgaggctcagagggattaggtaacttgcccatgatcattcacacagccagaagtaacaaaacagatctgaattcaacctttctgactctaagtccttgaacttgataccctacaatactgcctcaagttaacctgcactgaatatagtcacagttaattattcactgtatatccatgtaaataattatgtttttagagcaggggtatccaatctttttgcttccctgggccacactggaagaagaattgtcttgggccacgtataaaatacgctaacactggcgggcacagtggctcttgcctgaattccagcactttgggaggctgaggtaggtggaccacgaggtcaagatatcaaggccatcctggccaacaaggtgaaaccccatctctaataaaaatacaaaaaattagtcgggcgtggtggcgtgtgcctgtagtcccagctacttgggaagctgaggcaggagaatcacttgaacctgggaggtagaggttgcagtgagccgagatcacgccactacactccagcctggcaacagagcaagactctgtctcaaaaaaaaaaaaaaaaaagaaaaagaaacacactaacactaatgatagctgatgaaaaacacatacacacacacacacacacacacacacacacacacacacacatctcataatatttgtttttgtttttgttttgagatggagtttcgctcttgttgcccaggctggagtacaatggtgcaatctcagctcaccgcaacctccacctcctgggttcaagcgattctcctgcctcagccttcccgagtagctgggattacaggcatgcgccaccatgcccggctaattttgtgtttttagtagagatggggtttctctatgttggtcaggctggtctcgagctcccaacctcaggtgatccacccgcctcagcctcccaaagtgctggaattacaggtgtgagccaccgcacctggtcaaaaatctcataatattttaagcaagtttatgaatttgtgttgggcctcatccaaagctgtgttgggcctcatccaaagctgtcctgggctacatgcagtccatgggcagtgatttggacgagcttactttagagcaaataccaggtgatgtttctttaaaacagtttttggagaacaaatttcttagatctttgctgcccatgtcttccaatgtttacatataagccccaaatacatgccagtcatactaaccattacaaatctcaattctctcaagaactgaaagaacacctgatgatgttattaaataaatgactgatacgattatactaatctgagatgacatatactaaataaatgtagtcttatagttatcaaaaaattaagataaaattaaacatgaaggaaagggcaagagtaaaaggcagtgccttttaggagaattttttttttcattgaaactgtaaaaatgtgaagatactagaatgttaatttgactgctctaagaagtaattttttaactttgcacaaaacatagtatgaatgtcatatattcaattaaaaatgtgcttatgcatctagtaagcaaagctgaactacccttgcggaaatgtgttacctgttcaatggcctaagggataataggtaattttaaagagggtgatacgagcatttgtagagctctatataactgtataacatcatgtaaatttgtatgattttgttttgtgaatatagtttcaacttgctaagtaaagcagtaaggggcaaacactaaacttaccagttaaaaagcattaaacagttagactttgtaatgatagtctttcaaggtttacccttgctgccattatgctgctatgaaattctcaaagcatcttgagaaaaacaagctttgattccccttggaactttctaaacagggcaaagtatataaagtcctctcaagggaaagccagaagttaacaaaaaaaaggcattctataagcaagttaaaagaaagatcagactttaaacataagcatttttctgtgcatcatcctgaaagatttcaaaatgaaaagaagagaataaaaaaggataaagagtttaagaaaggccaggtgcggtggctcacatctgtaatcccagcacttcgggaggccaaggtgagaggatggcttgaggccaggaattcaaggccagccttgccaacatggcaaaaccacatctctacttaaaaaaaacaaaaacaaaaattagctgggcgtggtggtgtgtgcctgtagtcccagctacctgggaagctgagacaggagaatcgcttgaatctgggaggcagaggttgcagtgagctgagagcgcaccactgcactccagcctaggcaacagagcaagacttagtctcaaaaaaaaagaaattgactctaggcaaatgaccaataagtacttcagtgccggcactacccgtgcaaaacaggaaacaaagtgtgaagcaatgcaagcacatatgtgaaatttggctccacactaaatccggcttcatgcttaactatatattaaaaaaactggcaaactgccgacacatttttttttacaatacttatttttactttaatcaagactaagaactttaactatgaaaatgttaattagccaaatttctccagttctctatcaggttttaagcaatattttattatctaaacttttccacgtctttctcccctccttaccggttccttactacattgtttcataaataaccttttcaaatctgtaatttgaactaacttttagaaaacttccgaattagacaaaattattattttttctcactaatcacacaacactttctggcacattttgtatatagaattatgtgttaactagaattcttatccttagtaacctaaaacttcaatgaaacccgaaaaagcaagaaatcctgaaccatcagagataaaagcattatagataagaacaattccacaatttgtagaaacatatttccccatgtcacaaccttttcttaattggaactgacccagatattcaatgagcatcaaaaataattttaggacttttttttttttttttttttttgtgacagagtcttgctctgtcccccaggctggagtgtagtggtgtaatctcaactcactgtaacctcctcttcccaggttcaagcaattctccagcctcagccccccagtagctgggattacaggcacacaccaccatgcccagctagtttttatattttcagtagagatggggtttcgccactggccaggctggtctcgaactcctgacctcgggtgatccaccctccttggccttccaaagtgctgggattataggcatgagccaccacgcctggccaagattttaatttacacaaaaagattacctaaaacatttatcccattcactgtactcaattctttcatgtttaacggtttatttagataacttctataaacagagatatcagacactatcatttaaagttagttatttccttgctaaccatgtttttaatagccagcgaacataaggtgctcacctaaacctaagtaacagccttaaaggtaaatacactggtatttttttttgccaataactcagaagacttagttaacaacattaagttactctcattcgttgaaaaaaaaaagggcacacaaaccaagatcattttgtatgggctaagttagtagttttataaccttctatgccaaacattgacatctcaaaatatttagcagagacaaatataaaatccagacaaagaatgtattctgacaattctgaaggcatttctagttttattttactaataattttaaagccagcttgtttagtaaagttatacttaagtcacgtgaacttgaaaattgcttagacttatttacttaatttttaagtgctcttttatttataagccaatttggtagacacaacatgtaacaataagtgtgcatacaaataaacacatctagacatgtatagacgcacacaaacgaagattcaatcgcttttaactgggaatcttaaggcatgagatagcaatacaagcttggggggttttcctttgtttgccccaacagataatccaatgaaggctgtgaaccaaaatttcagatatagcagtttccacagcagtttgacacatgcaactccatcccactttcccattcaacagcaagctccagattccaaacaatattgggccaaacagtattgcaactgcgagagaaaattctaaggagggcttaatactagacctcagaactctgcctagggtgtcccctttggagaagttgaggtctggaggatccctgggccgtccccctttggggtccagtctcagagtgtcagacgtctctgaccttaggtgggcactggtgctgcttagcatgttttcccttcagaggcaatggcctactatgaggtttccttttgtccctggatgaaggcctggacttctggcatccttataatttgataaggccacactttcccatgcttcctgttccactagagtgatagccatgaactgtaatgataggaactggaggctgggtgggtttcttttgtccttagccagtagagtaggggaagggaagaatttagcatgagaaaacaaggtttaagtcactgaaacaaatgccagctcgccccaagctgtgccacacgtagggatcagggaccacaactggaaaagatagaaaggagtccttcagagtggccccggccagaaacctgcagttgcctctgtgtttaggtgctgcccaccaaccgtcccaagttggaaaggaaaagagagagagagactgagattcccctgtatggagcaggaaaaacaaacaagaaaaataaaccccaaactttgggattacctcctggctggcttgccaaaatatgttaccagtggaggctgtacaagttcttggtgttttgaacaaagaattgaacaaaacacacaaacaaagcagggaaagaataaagcaacaaaagcagagacttaactgaaaatgaaagcacacggccaggcacagtggctcatgtctgtaattccagcactttgggaggtaaatgtggggggataacatgaggtcaggagttcgagaccagcctagccaacatgttgaaacgttgtctctactaaaaatacaaaaattaggccaggcacggtggctcacacctgtaatcccaacacattgggaggctgaggcgggtggatcacgaggtcaggagatcaagaccatcctggctaacacagtgaaaccccatctctactaaaaaatacaaaaaattagctgggcgtggtggtgggcacctatagtcccagctactcgggaggctgaggcatgagaattgcttgaacccgggaggcaaaggtttcaatgagccaagatcgcaccactgcactccagcctgggctaaagggcgagactccatttcaaaaaatcaaaaaattaaaataaaaaataaaaaaaagaaaatgaaagcacactctacaggttgggagctggcccaagcaagccagccactcaagggtctggttacagaattttctggggtttaaataccctctagagatttccattgttacttggtatacaccctgtgtaaataaagatgatgaagttacaaagtcatttattcagtgtatatcctatgtaaaggaagaggatgcttcctgtcataactgaagtgcttgtttccatttgatttagttctagaaagttcttgggttccctgcctccaggtcctactcgcttgcatgattctcattgtgtcctcacagagtggaaggggaaaggcagatctttggagcctttttttttttttttttttttgagacagagtctcgctctctctcccagtctggagtgcagtggtgagatctcggctcactgcaagctctgcctcctgggttcacaccattctcctccctcagcctccagagtagctgggactagaggcgcccgccaccacgcccggctaattttttgtatttttagtagagatggggtttcaccatgttagccaggatggtctcgatctcctgacctcatgatccgcctgcctcggcctcccaaagtgctgggattacaggcatgagccaccatgcctcgcctggagcctattttataagggcactaatcccattcatgagggctctgccccatgatctactcaactcccaaaggccccacttcttgacatagtggtaattagatttcaacatatacattttgtgtgtgtgtgaggcagagtctcgctctgtagcccaggctggagtacagtagcacaatgtcaggtcactgcaacctccatctcccaggttcaagcaattctcgtgcctcaaccacctgagtagctgggattacaggatcctaccaccacacccggctaatttttgtatttttagtagagatggagtttcgccatgttgcccaggctggtctcgaactcctggcctcaggtgatctgcccgcctcggcctcccaaagtgctgaggttacagacatgagccaccgtgcccagcctcaacatataaattttggcaaagacacattcagacactatatatcaatatatacttatagagatatatatgcacgttttatttctatatgtatagccatgaggtttttatataaaaactatgttatatataaaacacatttaaggccgggcgcggtggctcacgcctgtaatcccagcactttgagaggccaaggcgggcatatcacctgaggtcgagagttcgagaccagtctgaccaacatggagaaaccccatctctactaaaaaaacaaaattagcggggcatagtggtgcatgcctgtaatcccagctactcgggaggctgaggcaggggaatcgcttgaacccgggaggcagaggttgtggtgagccaagatcgcgccatcacactctagcatgggcgacaaaagtgaaactctgtctcgaaagaaaaaaaaaaaaaaaccacacacacatgcgtgtgtgtacatatatatgtatatatgtgcgtgtgtttgtgtatgtatatgtgtgtgtatatatatatatatacacactttttttttgagatggagtttcgctcttgtcacccagactggagtgtgatggcgtgatctctgctcactgcaaattctgcctcctgggtttgctcgatcaagcaattctcctgccttggcctcccaagtagatgagactacaggtgcctgccaccacgcccagctaatttttgtatttttagtagagacggggtttcaccatgttggccaggctggtctcgtactcgtgacctcaggtgatccacccgccttggcctcgcaaagtactgggattacaggcataagccaccaccgtgcccagcctatatatacatttttgaaatatatatttatacatgtatatacataaaaaattttgatactatattatatatatacacaaacatagattatatatatctcagttactttggaaaaaaaatttttagagatgggttctcactgttgaccaggctgcagtgcagtggcaggaatatatctccctgcaacctcaaactgctgggctcaagcaatcctctggcctcagcctacagagtagctggtactacaggctcatgccactgcactcagctatattgtagttacttttatacctctttgcctctcagtggaagttttgcttggttatcccctcaaagggtggaagaagtggtaaaaaagaaaaaggggcaattacagaggcagttgggggaaaaaaaggaatggaaaaggatgatctaaagacagattttgccaactcagtgttttttgtttattttctgtctttgcctaagtttagtttaactttcagtaattttcttcaaaataaaaactctacattataaaaacaagcaaacaaaaaagataatggagggatgccaggcacagtggcctgtaataccaacacttctggaggccaaagtggcagaattgcttgagtataggagtttgagactagcctgggcaacacagtgagaccccatctctacaaaaaacttgaaaaaaaaattagccaggcatgatggtgcatgcctgtagtcccagctacccaggaggctgaggtgggaggatcacttgagcccaagagttcaaggctactgtgagctatgaccgcgccactgcacaagcaaatcattcaagtcttttatgtcaattctctgcagggaggtgcagacctgcaagaggcctgaagaaggcccaagaaggcctgactcatttcctcctcagcctgagttctaatggcaataagaaaggtcccaaagtgaaggagttcggcatcctgaacaactctgtctgactacataccacaattacagcaggcacctttcctagccccagacacacattctaaaaaagttttctgcaaaactatacaatatctttcctttacagcagttgaagagacttcactggaaatactagccaaatccagggagtaaatctgatacatctgaggttcccttcaggaaataatagcacagcagggtctgcatggggtgcttgttttcaacgtagctaaaatatcacacatgggctcagggatcttttattcaaattcccaatataaaataaaggtttagacattcaggagccaatatgcccatttttattcattttcttaaaaaaaatagccttcattttttaaagatagaaaaaaaatgatcaaataaatctcagggcttagctgtcagtaccttactgtttttttaaagatatatatattacccaaatgtggtagcctaacacttacctttgaagcatgtaatatctcatttccttattttcctctggagaaccctccatatcaagatgggaaaagaatggaagctttttcttcagatttcggccttgtaaacacaagccgcagttcctcctcctgttgcagctgcttaaaacccaggaggacaagagatactgtgccttctgcctggcttcagtcagactagaatactcctgatggcctcaaactatagtctttttgtctaattgttcccaatttccttctttccccacctttctcttcctttttgcatcttctctcctccacacacttagcttacacacacaattagttgatttcccaagggaactgagaggagccggggagaaatataaaagcttgtttaactagaaagtagatcttagcagctctcctttagttgcagcaaacattttcaacaacagtcactttcttctgacagtcaacggagaaaagctccactgcctctcctggctgccaggagcacatgacagggaaagcccaggacaaaaagaccaaatttacaaggacaattaagccaagaaaataatgggctcatgaaatccagagggaggagcacagctcggtctaaagaggtaatttctgagatccaatcaaaacaaataataccaattatcagactgcacggtggggaaaagcaggtcaggtgggaaagtaagcacgtagaaaggaaacacgccactactagggaacttagaatcaagtgtgagccacgattctaattttcaggccaaagtagtggtatatatagacacctaaactaaggttttatgcaccaaagcttgagaataggaatggagctggtacaaaacggatacagaaaagattgtgggttaaacccttaaaaggaaaagagaccctgacaaatattttggaggtctaacccccttaagcagggaagaaaaatcctgcctagaaagactacttactgagacacatatattactatgaaagcaaatttgccacagacagatctcttaaagaaataaacactagctgaatgttatcttgtaatatcttcctgtttttagcttttacttaagtagatgctcatgatattctgtgtattaggagaaaaatcaatggcaaaagaccctaaaggcttagaatctatagaaagacaacttcctgaggcaagtcctcaggcctgtacaccaaatctaacctgaatcatgaaccataaaaaatttattcccatcaaaatgctggatagaaatagttaacaatctgatgccaaccacgctgagaatatattaagcttccagaaaaaccttcaaaaacagaagtacacaaatgacctggagcatagatagaagttaaataatcagataaaagataaatgattacaacaaacaaacattgatctgaaggacattcgggcaacttaagttgtaaagactcaagttgcccaaatttgaaagcaactcaatcaggccacccaacatgacaaccagctataataaaaaatggaagtcctggttgttctctggtctgtacttcacatcatcccttccacaatgtgccaatgcccattaagttagtcaagtttactttccctttaaagaaccaagctgacacagaggagcccttctatctttacgtctcttcagaataacctgtctcaaaaatagagcactgcagcctttgttcaggaaagttcagtagccacagatgagaagctgctcaattttacacacacttaagtgtctacaaaacaaacttgttatacaagttcaccattcaaaaatgcaaataaagcactaagtgtaaaaataaggcagactattttgcactcaactatatcagaaaaatatactaaagaggcacactcaataatcgagtttatgcttcctttcaccaaacggatctttctacgacaaccaaacactaacacagcatacccaggtccaaaagcaaagctagagatctatatagatcttttatagacactgctgctcacaatctttctctaatattagaatacaagaaataaaaagccacattcatttctccaaatttaaagcatcccccttttaatctaccatgaacagtgtccaacgtagacacatacctggcacaaaatccaactagaagcccacactgatcccagcattgtaacatgccaaacaccaaggatgacgtagcagtttacccggcagacagtgatgcattcgctagcttgactgcaacacagtctgagttatactgcagcacacacactgtgagagactgttttacattgggtttttacaagcagagaaatcttggatcaaggatgtgtctctgtcaaaaaatcaagtgaccatatatttaaaggtttctttgtggactctaaattctgatccattgacctatatgcctagccttgaagcaatgccacatggtcttgataactgtgactttatagtaggttttgaaatcaggtagtatgaagacctccaacttcacattcccttttcaaaagtgttttggctattctaggtcctttgtttccatgtaaattttaggatcggcttgtcaaattctagaaagaaaaagaaaggctgctggaaatttgatatggactgtgaatttatgatcaatttaaggagaactgctgtcttgacaatattgagtcctctaatccatgaacatggactgcctctccatttatttagattttatttaatttcttttttttttcttttttgagatggagtctcgctctgtctcccaggctggagtgcagtggcacgatctccacttacaacctctgccatctgggttcaagcgattctcctgcctcagcctcccaagtagctggaactaaaagaacaccaccacgcccagctaattttttgtatttttattagagacagggtttcaccatgttggacaggctggtctggaactctttttttttttttttttgagacagggtttcgctcttgtgacccaggctggagtgcaatggcgcgatctcggctcactgcaatctgcaacctccacctcccgggttcaagcgattctcccgcctcagcctcccgagtagctgggattacaggtgactgccaccatgccaggctaatatttgtatttttagtagagatggggtttaaccatgttggccagactggtctcgaactcctgacctcaggtgatccacccacctcagcctcccaaagtgctgggattacaggcgtgagccaccacacccggccggtctggaactcttgacctcaggtgatccatccgcctcagcctctgggtttgggattacaggcgtgagccaccacacctggctgattttatttaatttctgtcagcaatgttccacaagttttagtgtataagtcttataccttttttgctcaatttattcctattttattctttttaatgctatcatgaacagaatattttcttaatttcatttttggattgttcatttctagctagcatatagaaatatacttaacttttctatatagatcttacaccctgtgatcttgataaactcatttaaaaattttttgttaacaattttactgagatacaattcacacaccatacatttcacccacttaaagggtacaattcaatagtttttagtatattcacatagttatgaactatcatcacaataaatttaaggacattttcatttcattatatgtgtcatttttttaaagagacgaggtcttgctatgttgcacaggctggacttaaactcctaggctcaagcaatcctcctgcctcagcctcccaagtagctgggactacaggaacgtgcaccacgcatggcaattttagaacatttttattacctccaaaagaaaccccatgcccagtagcagccactcctcatttctccaatatgctccccaatcctagccaaccactaatctactttctgtctttatagatttgcctattacagacatttcatataaatggaataatataatatgtggccttttgtgactggcttctttcatttagcataatgttttcaatgctgtagcatatatcagtacttcatttctttttatggttgaacaatatttcaatgtgtggacacaccatattttgtttatacatcatcagttaatggatattgggttgtttccattttgtggctcttattaataatgttatgaacattcatgtataaacttttatgtggacatatgctttcctttctcttgggtatacaataaggagtgaagctgccagatcatatggttcatatggtgagagtttagttttataagaaagtgtcaaattagccgggcacagtggctcacgcctataatcctagcactttgggaggccgaggcaagtggatcacttgagatcaggagttcaagaccggcctggcccacatggtgaaaccccatctctactaaaaatacaaaaattacctgggcatggtggcaggcacctgtaataccagctactcaggaggctgaggcaggagaatcgcatgaacccaggaggcggaggttgcagtgagccaagatcgcgccattgcattccagcctgggcaacagagcgagactccgtctcaaaaaaaagaaagtgtcaaattattttccagagtggctgtatcattttacattcccaccagcaatgtacaagaaatccaatttttctgcattctcacaaacctttggtattgtgtctatttcttattttaggcattctgataagtgtgtaatgatatctcattgctattttaatttgcattttcctaatactaattaatatttgcattttcctaatacctaataactattagataattataaaacatcttttcatgtgtttatttgccataggtatatcctctttggtttcatttgcttctttttaaaaatcatttctcttttcttattgagaatttctatttattttatttttaattttttgagacagagtcttgctcttttgcccaggctggaatgcagtggtgcaaacactcaatatgctcaagcgatcctcctgcctcagcctcccaagtagctgggaccacagacatatgctgccatgctcaaataattttaaaatttttgtagatggagtctcaaattcctgggctcaggaaatccaccccgcttgcctcccaaaagcactgggattacaagcatgagccactgcactcagctgagaagttctatttattgattcattgttgtcatgcttaaaaaaacagtatttaaggggccaggcgcggtggctcatgcctataatcccagcactttggaaggcagaggcgggcaataacctgaggtcaggagttcgagaccagcctgaccaacgtggagaaaccccatctctactaaaaatacaaaattagctgggcgtggtggtgcacgcctgtaccagctactcgggaggctgaggcaggagaattgcttgaacccgggaggcagaggttgcggtgaccaagatcgtgccattgcactccagcctgggcaacaagagcgaaactctgtctcaaaaaaaaaaaaaaatagtatttaagatggggcacagtggctcacacctgtaattccagagatttgggaggccaaggcaagaaggtcacttgaggccaggagttcgaaaccagcctgggcaacatggtaagactctgtccctataaaatataaaaataaaaataaataaatatgtttttaaaaattatttaaacatgttttcctttaggtctttgaacacatttacagtcgctactttgaaatctttgttaaatccagtatctagggacacttgtagataatttctgttgacttttttcctaaacatgggtcacattttcctgtatctttacatgtctcacggctttttaattaaaaattgaatataacctgtcatgggattagaaaacaaattatgcatatgaacaatttacaaattgaacatatgaacaatttggattctgatttctttcacccatgaaaattgttgttactagtttgtttttttctttcttggcttaatcatttgcctgagctaaatctgtgaattctgtttccctaacagtgtgcagccactgatgtctcagctcattttctttttatttcttggttttatgtttaaatgtggcttttgaggagtcacccctatgtctgtgtagccaatgattagatagagtttatgctcatatacttaaagctagaaaggcttttatcctctgtttatgggtctggagtatgggggatatagagtagtgcattcaaagttcaggtttttcaagtctgccctagctgttactttccgttgggccttatcatgtctcttctgtgcatgtacatgcctcagcctgcaatatgcttgccccaaccacaaacaggcaaagtcactggcctgtgccactcacccactgccaagtggtcacttctcccaacaatgccattgagcatggacatcatccaccacccaaactgagtaaactcccttcaaccacagcatcaaagcagctggtcttcatggtctacccacactggtaaaactttcatgacaaatcagctggggaaaggggaataggaacaatcccagacaagaataccacaaactcctactgttttacggaattttagcagtttttttttttgttttttttgttttttttttttgagacggagtcttgttctgtcgcccgggctggagtgcagtggcactatctcggctcactgcaagctccgcctcctgggttcacaccattctcctgcctcagcctcccgagcagccgggactacaggtgcccgccaccatgcccggctaattttttgtatttttagtagagaaggggtttcaccgtgttagccaggatggtctcaatctcctgaccttgtgatccgcccacctcggcctcccaaagtgctgggattacaggcgtgagccactgcacccggccagcagttttttaatcataaaattctctcaaattattgtatgccttttggttgatttcaagagtgttaaaatggttaattttgtcaagtttgtcaatcttcataattggtttttgtgttgaagatctgccagtctcctcattcagctatacctggaagtcctccctgttttatttactttttaatgaccgatataacttcatacaatgaagtggaaaaatcttaagtataaaacatatatatgtaaaattaatatatatatagccatataaccaatcacctcattaagatacagaatatttccagagtcccagaaggcttacttgtgtcccttcctagtcaatattctcccttaaaggtaaagactactctgaccttttataaccattgatcagtcttgtttactcttgaacttcataaatatagtgttatataatgtatgtactttaatgtctgacttcttttgatcaatattatgtgtataaatttattattatttttttttttgcaatggagtcttgctctgtcacccaggctggagtgcagtggtgcaccctcggctcactgcaacctctgcctcctgggatcaagggattctcctgcctcagccttccaagtagctgggattagaggtaagcaccaccacacccaggtaattttttttgtatttttactagagatgaggtttcaccattttggccaggctggtcttgaactcctggcctcaactgatcctcccacctcagcctctcaaagtgctgggattacaggcgtgagccaccacgcctggccttatgtgtataaaatttatctatgcttaccacttggtcgaatttatggaaaaaaaaattcacccatgttgtgatacagcagtagtttgttcattttcatttctgtatggtattccatcatatgatataccatgatttacttacctattctactattcacggacatttgggttgtttatgaattttgacaatatttgcttatttctgatggataaatgaactaatttcctctgggaatatacactaaaatgaaattgctcactagtgaggtatgtgcatgtttagctttaaatgatactgctaaatagttttctaaagtggctgtaccaattcatattaataccagtgatgtgtaagagtcagtgtgttccacttccttgctaacacttgatattgctcgttttttaattttaccttttttggttgggctatgtgtttaactcattgtaattttaatttgcaaatccctgatgactagtaatattgagcaccttttcatatacttacttgacatttggtatcttcttttgaagtgcctgttgaagtcttttccccatatttctattgtgttgaatgtcttttttcttattgttttgttttgttttgctttgtttttgagacagagtctcgctctatccctcaggctggagtgcaatctcagctcactgcaacctccacctcctaggttcaagtggttctcgtgcctcagcctcccaagcagctgatactaaaggcgtgtggcaccatgcctggctaattttttatatttttagtagagatggggtttcataatgttgtccaagctggcctcaaactcctgagctcaggcaatccatccaccttggcctcccaaggtggtaagattataggtgtgagccactgtgcccagtcataagatccttatagtaggatattttaatattcttcttcagcaactgatataacaagtagaaaaaaaaaatcaaagacacagaagaacaacaaactgaaaaactgaacatacatagaacctataatcaccaactgcaacatatacattcattgcaagtgtttatgaaactttatcaaaatagaccatatactaagccataaagtatcaataaatttcaaaggtctgaaatcacatagcgtatatgctctgaacacaatggattacactaaaaatcaataacaaaggtaataaaatccacaagtgtcttgatatatttctaaacaatttatgagtcaaaaaatcacaaggaaattaagaaaatattttaattgaataataatgaaaatgtatatccaagcttgaggaatataataagacgaatttatgagtgaatacagagatgaagagatggatatcaacaaagccagaagttaattctttgaaaaggaactgaattgataaatttctactaagactgataaaaataaaagaaaaaaatgctaattgccaatatcaggaatgaggacaagggaatcactataaatcctatagacatgaaaaacaagcatattattacaaactttatgccaataaatttgaaatgttagaaaaaaattgataaatttcttaacgactttccattccacccagaaagacatgaaaatctgaataatcctaaatctactacagaaatcaaatacataatatgtataatttaaaaactactagccaggtgtggtgactcacgcctgtaatcccagcacgttggaaggccaaggcaggtggatcatttgaggtcaggagtttgagatcagcctgggtaatatggtgaaacactgcctctactaaaaatacaaaaattagctggcttagtggtgcacgcctgtaatcctagctactcgggagactgaggcacaagaactgcttgaacctgagaggcggaggttgcagtgagccaagattgcgctactgccctcaaataaaataaaataaaaatgaaaatggaaaaacaaaaactactactattatcttttgtgactgttcccaatcagtctttatacctctaccatttattcacaagtatttattttatgtttttatttactttgtagagacagtcttgctctgttgcctaggctggagtacagtagcatgatcatagttcactgcggccttaaactcttgggggctcaaacagtcctctcgcctcagccttccgagtagctaggaatacaggcatgcaacaccatgcccagctattaaaaaaaatttttttttgtagagtataggtctctctatgttgcctaggcttgtcccaaattcctgggctcaagcaaacctcctgctttagtctcccaaagcgctgggattacaggcatgagccacgatgcctggcttcaacaagtatttattgagtgactattatatgctatagaaaatgatgagtatacagctataaacaaaatatatggcttctgtgctcatgttacagtataatggagacaagaaatcaaataaatatattactaaaaacattacaaattgtgataaatgctattgcaatgggaaaaaaaggaacactgtaacaatagagcctctttggggaaatgatatttgatctgaaacctaaaggataaagacctcaagtgatcaaagagagtgaaagtgaattctaggcataaggaccagtgcatgtggccttgagataggaaaaatattggactactatcttttcaggggaactgaaaggccagtatgattgaagccctgtcagcaaatggaagttgacagaagtcagatcattcagggtctcatgagctgagttaaaaattttgtatctaggccaggtgtggtggcttacacctgtaatcccagcactttgagaggtgaaggcgagaggatcacttgagtccgagactttgagaccagcctgggccacatagtgagaacacatctctacaaaaaaatttaaaaattatccaagcagggtggcatgcacctattgacccaggtacttgggagtctgaggcttgagcccagaagcttgaggctgcagtgagtcctgtttgcactactccagcctgggtgacagagcaagaccctgtttcaaaacaaaaaaacagaaaaactagaattttgtatcttatgctatgtgcagcaagaaataaggaggcaaaagtataatacagacaggaaatctagttaggtgatcattctaatagtccaagcaagagctgacgtgctaaggcttggactaaggtgattgcaagtgaaggtactggggtcaataccggagatagaatcaaccaaactgaagtacaattcccaggttttttggtttgagcagagtggctggaggtgctatttagtgagatgtggaagattgggggaggatcaaatttatgaagaagataggggaaatcaagaatttaatgtctataagacattcaaatgaaaatgtcatatgaataggtgaacataacaagtgatctcagaggataggtctgggatggatattataaatttgggaatcatcagcatataagcagtagcaaagggatgaattttatatatagaaaatgtggctgggtacagtggctcacacctgtaatcccagcactttgggaggcagaggcaggtggatcacctgaggtcaggagtccaagaccagcctggccaacatggtgaaaccctgtctctactaaaaatacaaaaaattagccaggcatgatggtgggcgcctgtaatcccagctacctgggagactgaagcaggagaatcacttgaacccagaggcagaggttgcagagagccaagattgcaacattgcactctaccctgggcaacagagcgagacaccatctcaaaaaaaaaaaaaaaaaaaaagaaagaaaatgtatatcaagtaaaaagataagaaggaccagaaccaagcaatgaaagtattcaacactcaaaggttgcatgaaagcagaaggacttgcaagggagactggagattggtaagagtagaatggaggtaacacaggagtcatgaaagtgtagtctttagcagaaaagaaggcatgtgtttcaagaaaaaagtagtcacttgtatggaactgttgagagacttagaaggatgagaactgaaaagcatccactgatttagcaatacagtagtcattagtggtttttacgagagcagtttcaatagcatagttgggcagaggacagaacagaatagctttaagaatgaatgggagatgaggaagtagggatagcacttctgaaaatcttgaccataaaatggggcagagagataaggcaataatccaaagggaatgtggctatcaaaaaaaggccttctataaagatggaagaaatcagagtgcttggaacacttctcaggaccctccctcctttggtcatcctctgttccaagcacttggaacacttctcaggaaagaaggaaaaatgttgtcagcattgttctgggttacaaaacacacacacacacaaatacacacacacacatacatacatatgcatgaagaaaaaatgagaaggagaatacagataaaagtaagtttgaaatgaggtgttagaagaattactagatagtctctattttcttaataaaataatgtggcaaagctataaattaaaagtgtctagaagaggcaggaaatggcacaaatggaactgctggtttaaggacaatggagaagaaatgaaattactgttgcagaaaatggaaggccaaattaccagaagagaaaaacaatataggagaaagaacaagaaaagcttcatattagttgggcatggtggcgcgcacctgtaatcccagctactcgggaggctgaggcaggagaattgcttgaatccaggaggtggagtttgcagtgagccaagatcatgccactgcactccagcatgggtgacagagcaagaccctgtctcaaaaaaaaaaaaaaagaagaagaagaaggagaagagaaaaaagaaaagcttcatagcagaggcagcatttcagaaggtctttaaagattgatgacctcagatgggcatggtgactcacacttgtaatcctagcatttgggaaactgaggtgaggagatcacttgaggccaggagtttgagaccagcctggacaacacagcaagacttcatctcattaaaaagaaaaaaaggagtgatgacctccaagggtaaatggaatttcaacagtcagggaaatggcatttcagtaaggatacatgacaaagagagacacaggaaaagagactgagacacaaatagaatgatcaaaggacataaagatggaaagtatatggaattttaggaaacaggcaattgtctactgcaactggaataagcaaagagggaaaaaacactgggtagaaacaagactggaaaaatcagctatggcctaattgtggaagaatctgaataccatgactgaatgcctccaccacttattaggtaggaaaattacataatctctctgagcctgtatcctcctcttctggaaaatggagataattaacgcctattttacaggactgactgttgtttggttacataagataaatattgaaagcacttagtgcttaactcacagtaaatgctcaataaatggcagtaaaagttggggttgttatcttgggctttactctgaaagcagagggaaaacattacatgtttttgaacagatgtgaaacagggagagactaaagtaagagaaaatagttaaaggccattgtaatagactaggctagagataatgaacacctacataaagtcagtgatggtgggaactgaaataataaaggcagctgggcccggtggctcacacctgtaatgtcagcatttcgaaaggccaaggcagaagaatcacttgagtccaggagtttgaaaccagcctggacaacgtagcaagaccccatctctacaaaaaaaatttttaaagaaacaaaaaaaatatataaagggaaaaaatatagagatgacatgacacaattagtgggtcatgatacatttggcagatcaggatatcctggaacccaaattcaatattctgaacactctgaagaatctttccttgatgaactcctagacattttcctgactaatggagtcccagtttcatgactatcattagattttactagggaggaggttagaatttttacttatgaagaattattaaatttagcattttgagataagaattttggggggttgcaggagggagagcatcaggaagaatagctaatggatactgggcttaataccaaggtgatgggttcatctgtgcagcaaaccaccattgcatacatttacctcctgcacatcctgcaggtgtaccccataacttaaaatagaagttgaagggaaaaaaaaaaagaactaaagaactatgaatcttgggagaaagaatactcagaaaaatatgagatatcaaactatggttattacaacttcattttcatttcaacaaacagtatctccatctgacagaggattgatagccagaatatataaggagctcaaacaactcaataggaaaatatctaataatccaattttaaaataggcaaaagttctgaatacacatttctcaaaagcagacatacaattagcaaacagctatatgaaaaggcgcttaacatcactgatcatcagagaaaagcaaatcaaaactacaatgagatataatctcactccagttaaaatggcttttacccaaaagaggcagtaacaaatgctaagaggatgtggagaaaagggaacccttgtattggtggttcccttgatggctgtataaattaaaacacaatgggaatgtaaatctccatacaaccactatggagaacagtatggaggttcctcaaaaaactaaaaatggaactgccatacaacccagcaatcccacagctaggtaaatgcaaaaaataaaggaaatcagtatattgaagagatatctacactcccatgtttattacagcactattcacaatggccaagatttggaatcaacgtaagggtccatcaacagatgaatggataaaaagaaatatgtaataaaatagagagtatatctactccatacacacaatggagtactattgagccataaaaaagaatgaggtagatatttccctaagacatatttcctttctactatatattcttttttttttttttttttgagatggagtctcactctgtcacccaggctggagtgcagtggcgaaatcttggctcactgcaagctctgcctcacgggttcacactattctgcctcagcctcccgagtagctgggactacaggtgcccgccaccatgcacggctaattttttgtatttttagtagagatgaggtttcaccgtgttagccaggatggtctcgatctcctgacctcgtgatccgcccgcctcagcctcccaaagtgctgggattacaggcatgagccactgcgcccgaccactctactatatattcttgtgcaagtagatttccatttgtacaactttaatttcaatgtaacaaacatttattaagcactgaaatgtgccaagcattgttctaagctctgaaaaagtgcttcttggctcaggattcataccagactctcctggaaagtattagaataacgattcctgggctccacgaccagaggctgtaatctaataaatccgggataggactcaggaatccacactttttttttttttttttttttttgagatggtatctcactctgtcaaccaggctggaagtacagtggcacaatcttggctcacagcaacctccgccttctgggttcaagtgattctcctgcctcagcctcccaagtagctgggactacaggtacatgtccccatgcccgggtaagttttgtatctttagtagagacgtggtttcactgtgttggccaggctgttctcaaactcctgacctcaagtgatttgtctgcctcagcctcccaaagtgctaggaatttacaggcatgagctaccgcacccggccaggaatgcttttttttttttttttttttttttgagatggagtttcgctcttgttgcccaggctggagtgcaatggcacaatcttggctcaccacaacctccacctcccgggttcaagccattctcctgcctcagcctcccgagtagctgggattacaagaatgtgccaccacgcccaactaattttgtatttttagtagagatggggtttctccatgttggtcaggctggtctcgaactccccaccttaggtgatccacccgcctctgcctcccaaagtgctgggattacaggcgtgagccaccgtacccagctggaatccatatttttaataaagtctgttgcacagttaaggagaacctaaacattgttttccattttacagatgtcttatgtctgagctgtatttacttacaacactttgacaccgaatgtacaggtttttttccatatcaacaaccagttctgtccagctaccaactgggagtctcacaattgaattcttatattaattacccagagttagcacagatcctacaggttaatggctcagtcccacaagactgtcccctacttcagataccagttgcaaatcccagccacctatactcctgaccaaccagctataaatcggagattcccatgaccccttcctcgtgtttgataatttgctagaatgacatacagaacacaggaaaagagtttacttactattactgctttataaaggatacaactcaggaactcaggaagagacatatagggcaaggtatgggggaaggggcacagaacttccaaaccttcctccaggcatacagctctaccagaacctctatgtgttgaccatcccagaagctctatgaactctgttgtttacaaggttttatggaggtttcattaagtaggcatggctgattaaatctctggccacttgtgattagctcaattttcagccccttgcccctccctggaggttagagagcagacttgaaagttccaattctctaattattccttggtctttctggttaacagaccccagcctgaagctatccaggggccctcagaccccagtcatctcattatcataaaagatacttaccggtcaagaaatcccaagggctttaggaactgtgtgccaggaaccaaggatagagaccaaatgcttatttattatcacagtatgacatgaaagacccttaatgacctgacctctgtcttaccggcctcttcttttgcaccaaccatgctgcccaccttccattgcagtaatagtcaatgacttgtaattgcctgaaaatgctagacgtttcactgatacttctgcacattgtctaccctaccagctctacccttacatacacacacacacacacacacacacacacacacacacacacacccctaactttgctagccttttttctgttcatccttcaaattctagttcaaacatctccaagaccttattggacccttaacagaactcattgagcccaccataataataattagtactgttgtgagtattagaaataatgttaagcacctgtgacacaatgtttggctagacactaacatatcctatgggtaacaagaaccctctgaagtagtgtcatgagatgaagatgtggagaaaggggaaacctcgtacactgttggtaggaatataaattagtactgccactacggaaagcagtatgaaacctcttcaaaaaactaaaaatagagcttccatataacccagcaattccactactgggtatatatccaaaagaaaggaaatcaacatatcaaagagatatctgcactccatatttactgcagcactattcacaacagccaaaatttagaatcaggccaggcgaggtagctcatgtctgtaatcccagcactttgggaggccgaggagggtagatcacctaaggtccagagttcgagaccagcctggccaacatggcgaaaccgtgtctctacaaaaaatacaaaaattagctgggtgtggtggtgtacgtctgtagtcccatctacttgggaggctgacgtgggaggatcacttgagcccagggaggttgaagctgcagtgagccgtgatcatgccactgtactccagcctgggtgacagagaccctgtcacagaaaaaaaaaaaaaagaaaaaaagatttgcaatgacatgagaaagtgttgttatatggggaaaaaaagcagaaagcagagctgtatattcattataatatcatctatatgtatatttttaatgacatttatccttaagtggtaaaaaatacagaaaggaaatatataaaatatgaatagtgattactatggaatgattgtattcctcagtgtttctatttttttaaatactttttgaggctgggcgcggtggctgacgcctgtaatcccagcactttgggaggccaaggcaggcggccctgcctaggcaacagggcgaaaccccgtctctactaaaaatacaaaaattagctgggaatagtggcgggcacctgtaatctcagctacttagtaggctgaggcacgagaatcgcttgaacccgggaggcggaggcagtgagccaagatcatgccactgtactccagcctgggcgacacagcaagactctatctggaaaaaaaaacttcttggatttcctacttttctaataataaacctacattacttctaataatttaacaatataaagtagtaaatgcaaacttcatttgtaaatttatgctaacagaaagaaaagagggggaaatgcatgcattacacttgaaataataaaagtaataaacactgtcaagcagctgtaccgagccttacttacaacattcataatttcatttccacaattagctaagtttatagaatgcactccagagactaaaatacatatatggccacagacagctcctgttttctgaatggaaagaaggggaggatgggagatggaaagaggaaactagttccctcagcaaaggagtaccaagttgcagatctcataatgaccttctctgtctactcactacaaaggcaccatggcaactgggaacctcagaatatcaaggaaggagcactgaaagtagaaagtttggagagctattaggggaagggaagaagctcaggaaagctaaatgaaaaatgctaagaaagtcaatacataagaacactctcaaactatccataagcaaagccttaatataaacaaaaccagagccaatttccttatttcccatgtcaaagcttgatagtgatgaaccaatagataggaagcaggaataaaatttcctgcactttcttttctttttttctgtttttgagatggagtcttgctctgttgctcaggctggagtgcagtgcagtggcgtgctgtcagctcactgcaacctccacctcccgggttcaagcaattcttatgcttcagcctcccaagtagttgggattacaggtgctcgccaccacctggctaatgtttgtatttttagtagagacaaggtttcgccatgttggccaggctggttttgaactcctcacctcaggagatccacctgccttggcctcccaaagtgctgggattacaggcgtgagccaccgcgcctggcctcctgcattttcaatagtggttattctcaacgtttgaattataatattgatagtatatatttgccatcatcaaaaggctttcagacctaaatttccaagttttaagcactaacatgcaaaagacttaaagaggtttttccagtaaaaaatttttatcttataaaaggactccttgataataaataatgtattataccaatatggcacattttactattccaaaagtttcatagctattacttaactctatctctaccactagatttaaataaagtcatttcaaactcaaggagtttaaagtgagactaaaaagaaatgagaatctgtatgtctttcctagtcaaacacaaacatatatagctaaaactaaaaagctctgtcataaatggtacataaaatgattataaaattcattaaaatatcatcattaatgcaattaataccaattgttgctctgtaactataaaaagtgtagaatggtaaatcttcctttatttttccttctgtttctctatatgctaccaaattttcactagcaatcatatactttcatgatttgctaacttcctcttaaacgagtcactagtcactgtcataaaaaaaggtggggggtggtaatgtgatagaatgtgacagattaagaaatttaaagaacataatacacaatttgtggattggatacttgcatgaaggaaccagaattttcaggttccttggagaaatgaatagagtgtgtatattaaattagattaaaatttattgaaatagaaagtgaatttttttgactaaaaaaagcagattataaaacagtgtgtacagtatgacctcattttagtaaaaaaatatgaatatatacatatatgcatagaaaaggatacagatggtagggagtaacctttgggtggcaaatatacaagcgtttatgtttgcttgcttgtgttgttttttattttctattctgcttctttaataaagcatgatttaaaaaatattttttctaggctgggcacggtagctcacacctgtaatcccagcactttgacaggtcaaagtgggaggaccacttgagcccaggagttcaagaccaccctgggcaacgtggtgagaccccatctctacaaaaaaatttaggccaggcgctgtggctcacgcctgtaatcccagcattttgggaggccaaggtgggtggatcacgatgtcaggagttcaaaaccagcctggccaagatggtgaaaccctgtctctactaaaaatacaaaaaattagctgggggtggtggcaggcccctgtaatcccagctactcaggaggctgaggcagagaattgcttgaacttgggaggcagagattgcagtgagccaagatcatgccactgcactccagccttggcaacagagtgagactccatctcaaaaaataaataaataaataaataaacttagctgggaatggtggcacatacctgtagtcccaactactcagggactgagcaagaggattgcttgagcccaggagtctgaaggtacagtgagccatgatcacaccactgcactccagcctggacaacagagagaaaccctgtctgtaaaaaaaatttttcaagtatatataaatatatattttctaacttctatccctttctaacaaggctaacatttaattagagaagaactgctcaacagaccataaggcctgggcgcagtggctcacgcctgtaatcctagcactttgggaggctgaggtgggtagatcacctgaggtcaggagttcgagaccagctggccaacatggcgaaaccctgtctctactaaaaaaacaaaaattagccaggcatggtggcgcacacctgttgtcccagctacatgggagcctgaggcaggaaaatagcttgaacctgggaggcagaggttgcagtgagccgagatcacaccactgtattccagcctgggcgacagagcgagacttcatctcaaaaaaaaaaaagcatatctgttacaccaaaggttttagtttagtgtagtagtttatagtacgagctctgactagattcaatacccaagctggccaccttgggcatgttatttaatttatgtctcaattccccatccataaattgtgggcaataggccaggcacggtggctcctgcctgtaatcccagcactttgggaagccgaggcaggtggatcacctgaggtcaggggttcgagaccagcctgagcaatatggtgaaaccctgtctctactaaaaatatgaaaattagccaggcatgatggcgggcacctgtaatcccagctacttgggaggctgaggctagaggattgcttgaacctgggaggcagaggttgcagtgagccgagatcacgccatcacactccagcctgggcaacagagtgagactccatctcaaaaaaaaaagaaaaaaaaaaattgtgggaaataatagcacaatacttacctcatgggattgttttgataattcagtgtggtactccacataaagcacagcagagtatccggcatacagtaaagcacttattaaatgtaacctattattaccattatttttctaattagccactgagaaaacttgactaatatttcctaaagttaatgtgaaaaatagaatgtaggaacaatagataggccttctctcactattgtcctctaaacttctcttttgacccaatggaagaagttgaaagtcaatcccagatcctcccagaatctgaccttgacactattactgcccaaggataaaggtctgcacagctttatatgaattgtgaatgaaaatgaaatctggctgggcgtggtggctcacacctgtaatcccagcactttgggaggccaaggcaggtggatcacgaggtcaggagttcaagaccagcctgaccaacatggtgtctctactaaaactacaaaacgtggccgggtgcggtggctcacgtctgtaatctcagcactttgggaggctgaggcgggcggatcatgaggtcaggagatcgataccatcctggctaacacagagaaaccccgtctctactaaaaatacaaaaattagccaggcgtggcggcatgtgcctgtagtcccagctgctggggagggtgaggcaggagaatggcgtgaacccaggaggcggagcttgcagtgagccgagattgcgccactgccctccagcctgggcgacagagcgagactccatctcaaaaaaataaataaataaataattaaaaaaaaatacaaatacaaaaattagccgggcatggtggtgcacacctgttatcccagctactcaggaggctgaggcaggagaatcacttgaacccaggaggcggaggttgcagtaagccgagatcgtgccactgcacccagcctgggcgacagagcaagactccatctcaaaaaaaaaaaaaaaaatgaaatgtggtatctaggagcttattccaaactcattaacatactatgactagtatcatgggagaaactttacaaattatttataattacaaaagagctcaaaattttctagttaaattattctgaagagtccaacatctttacaggcaatctcatctgaattctcaattttcaaaaatattggtaaagtacttttctttctagatcagaaaagaaatagaaatataactcaacttcagagcccttcctgagtgaatatactttctccttccaaagcaacaactattgtcttgaaccccagtgatagacatcttacgctggttttaggtatacacatataacagcaaatacagattgttctcagataaagttgttaaccaaacatgcttcattttatgttaaccataaaatgaagatcattcagtgacttgaacatatgttttaagacacatgagagaaaattgagatcaagtttcaaatactattgatatgggaaggggacagggaagtgctgggtagagaagggcagagtccctgtcaagggctccacctttgacctgtacctatggacctaagtgagaacaggcatgcctgtttttgcatccaaatgcttcattttccaagaccactctggcctgcaacacccccaatcctgtgcccaaataaacccgagaccacagcaggcacagacacaagtgattgaacatcaagaggagcagaggaacagaccagcagacaccagcaggccagcagacttgcaatggtggaacgacaaggcagagaaagagaggagggacgtctggacaccgaggggaattcaactcggggccgtcagagaagagtccggcctccaggagccctgattcctggggaagaccacctccctactccagcccctccttccagctccccatccatgtcgctgagagccacttccaccactcaataaaaccttgcactcatccttcgagcccacatgtgatccaatttttctggtacactgggcaagagctcaggatacagaaagctgtcacactggccctctgcccttgcaataaggcagatggtctattgagctggttaacacaagctgtctgcagacagcaaagctgaaagagcacactgtaacacatgctcacttgggctttcagagtcgcagacaccaccccaagatggtgccgtggggctggagcccaaaagtgcttcccatggctgttgcacctgcccatctgcatcctccccttaggggtttgagcagtggggcaaccgaaggagcaagcaagacacatccctgtggtacatcctgcaagggagatgagggaactctcctgtttcactataacatgaagtatacactgggcaaggtagctcacacctgtcatcccagcacttgggaaggccaaggccagacaatcacttgaggccaggaattcaagaccaaccagggcaacatagcaagaccccatctctaaaaaaattttaaaaattagctcagcacggtggtgcacacctataatctccactactcaggaggctgaagcaggaggattgtttgagcccaggagttggaagttagtgagctatgattgcgccactgaacacttcagcctgggtgacagagtgagaccaaacaaacaaacaaaaaacccatacatttagcataggataaaaaagatttaaagaaatcacactatgctagagaggaaggaggtggatttttaaaaaagaggaaagaaatcacactatgctaagaggtaaaagacccaaatgtggagataacctgttccaactgtacttcaaccagaaattcagcttattagttgacaaactgtttacagttctatttggttgatagcatgcggtgaattttaagtatgcaaaacgatctgacctcaagtgacatcccataggagcagagaaactgccaatatccatacaactagatggctctgttatatgccaccaaatcatacactggttatcaaaattaagatgtccactggccgggcgcctgtaatcccagcactttgggaggccaaggcgggtggatcacctgaggtcaggggttcaagaccagcctggccaacatggtgaaaccccatctctactaaaaatgcaaaaaattagctgggcacagtggctcacacctgtaatctcagcactttgggaggccgaggtgggcagatcacctgaggtcgggaattcaagaccagcctgacctacatggagaaaccccatctctactacaaatacaaaattagccagacgtggtggcgcatgcctgtagtcccagctactggggaggctgaggcaggagaatcacatgaacctgggaggcggaagttgcagtgagccgagattgcgccactgcactctggcctgggcaacaagagcgaaactctgtctcaaaaaaattaataaataagccaggtgtggtggctcacgcccacccatactcccagcactttgggaggctgaggcgggcggatcacgtgaggtcgggagtttgagaccagcctgaccaacatggagaaaccccatctctactaaaaaatacaaaattagccaggcatggtggcacacgcctgtaatcccagctacttgggaggctgaggcaggagaatcacttgaacccgggaggcagaggttgcagtgagctgagatcatgccactgcactccagcctgggcaacaagagtgaaactccatctcaaaaaaaaaaaaaaatttgccaggcatggtggcgcatacctgtagtcccagctactcgagaggctgaggcaggagaattgcttgaacccgggaggcggaggttgtggtgagccgagatggcaccattgcactccagcctggggaacaacagtgaaactccaactcaaaaaaaaaaaaaaaattaaattaaaaaaataaatgaataaataagtaaaataaaataaaatacaaaaaattagccaggcatggtgggctgggcacagtggctcacacctgtaacccagcactttgggaggctgaggcaggcagatcacaaggtcaggagttcgagacctgcctgacgaacacggtgaaaccctgtctctgctaaaaatacaaaaattagccgggcatggtggcgcgcacctctaatcccagctactcagggggctgaggcaggagaatcgcttgaacccaggaggcggaggttgcagtgagccaagatggcgccactgcactctagcctggggacagagcgagactccctctcaaaaaaaaaaaaaaaaattagtgcggcatggtggagagcacctgtaatcgcagctacttgggaggctaagggaggagaattgcttgaaaccaggaagcagaggttgcagtgagccaagatcgcgccattgcactccagcctgtacaacaagagtgaaactcagtctcaaaaaaaaaaaaaaagtccacattcagcctttcttcttaaatgttcaattgaatactagtgagttccagaaatatatcaacctggctgatatatcaacctctagctgatcatatctaaaaataaaaagccaaatcagttgtctacaatgaggtctgtatattcccaccaagctataactactttttacttagggtcttattttcttttctttctttttttttttttttttttttttttttgctctgttgcccaggcgggagtgcaatggcatgatctcggctcaccgcaacctctgcacccccggattcaagcacttctcctgcctcagcctctcgactggctggaactacaggcatgtgccatcgtgctcggctaattttgtatttttagtagagatggggtttctccatgttggtcaggctggtcttgaactgctgacttcaggtgatccacccaccttggcttcctaaagtgctgggattgcaggcgtgagccaccacgcccagccagggtcttattttcaaatgtttgggtcataaagcttagaaagtgattcatccagctgggcatggtggctcacacctgtaatcctagcactttggaaggctgaggcaggcggattgcctgagatcaggagttcaagaccagcctggccaatatggtgaaaccccatctctactaaaatacaaaaaaattagccgggcatggtggcacacacctccagtactagctgctcaggaggctgaggcacaagaatatcttgaacctgggaggcggaggttgcagtgggctgagattgcaccactgtaattcagcctgggtgaaagagcaagactgtctcaaaaaaaaaaaaaaaaaaaaatggccagggtcaggcataggctgacaggcacagattacaggctcatgcctgtaatctcagcactttgggaggccaaggcaggtggatcacctgaggttgggagttcgagtctagcctaacatggagaaaccctgtctctactaaaaacacaaaatcagcctggcgtggtggcgtatgcctgtaatcccagctactcaggaggctgaggcaggagaatctcttgaacccgggaggcagaggttgcggtaagtggagattgcaccattacactccagcctgggtaacaagagcgaaactccgtctcaaaagaaaaaaaaaaaaggctgggcatgctggctcacgcctgtaatcccagcaatttgggaggctgaggcgggcagatcacctgaggtcaggagttcgagaccagtctggccaacacggtgaaaccctgtctctactaaaaatacaaaacagccgggcatggtagcgggtgcctgtaatctcagctacttgggaggctgaggcaggagaattgcttgaacctgggaagtgaaggttgcagtgagccgagatggtaccactgcactccagcctgggcgacagagcgagtctccctctaaaaaaaaaaaagaaagaaagaaaaaagaaagtgattcacccagtctttcattggactctagaaaatacatggggcaaatcatctccatcgcaggaaaagtctattttctatttgggctcatccatcataccactagacttctcagcacctaaacttgagagagagactcagtcccatcttacattatggcaattacttcatttggtttcagatgacctccagttaacatctcctaggaatgtacctgcccccttaatctatgtcacccatgaaggattaggctattcgttctaagagctgatcctaaactcaacttagtctctatttaactttgagttccaggagtgaaaaggagcatctgaatcaatatcttcatttttatagatgactccaaggagataatatgtactgtccatggtcacacacctaattagtggcagatgtcataacagaggtctttcacctatcaaatgaatttgactcaattaaaattaccccaaaggtcaccatatccagaagtgacttaaggaatggataaacagaaaacgttttttctattttagaacattagctagctgaggagtgagttggaactggcattgtctcctttccatgctgctgatcacacttcaatccatggctcctccacgagctacggacatgatttttgcaacagtaaggcatgcaaagaaattccagacactcatgccactgaccacatagactttgcataagaaccatcaactttgggaatgacttggcaactacaaactgccttgtgatatcactagctgagtttcttataacacatttatctcaccatagccaaactcagtttcctaatccagcaaatggatattatgtttcacatagactcaaactggacagatttctcaaggtgctgtgtggttttatggatttagagttaaaccagtctttctcaacaggggcactacgacattttgagtagcagatttcttggttgtgtaggattatctactataccacagaaggtttagtatcattggtcctttgtcctttgtccgataaatgcaagtagtcctgccagtcacaaccccccaacacacttccaaatgacctcaagagagaagaatgccaccactagtattaaccttagagccaatcattaagtgaactataaaataaaaaatgtttacataaagacctaatcccttttccctgccactaaaatactgctctctattcctctttttaacccagagataatgctttgttcactaactccataaaaccaactttgtctgaactagttatataattaagacacctgtatggacgggaaagtagagtagaaaagttagtgaaataaaatcaggatatgagtttgaatccaagttctctggctattcaaacttaggcaagttatttctcctcattgggccttagttttcccaactatcaaaaagtattttgtggccaggtgtggtggctcatgcctgtaatcccagcactttggcaggccatgataggaggatcgcttgaggccaggagttcaagaccagcctgggcaacatagcaagacctctgtctctatttaaataatgttttaaattaattttttaaaataaaataaaataaaaagtgttaggctaaattatctctctggtttattacaattctaggaacctgtgaagtaaaacataattaacttgctttacacttttcttttgacctctacatagctaaatgagggtgaccactaacgaacactgcctagtctctcagaagccccgatcccaagccccagggataacagtaagacagaacaatcacatccagccagatctcatacaggattttattatagagttgatatatttagtgtataaaatagagctgaattattttatgacccattaataataaaggtgccaagatagtaacagcaacaacagccaccctaacttatgttatctagggtacacctataatctgaatgctggctgtacacaacaatcacctggataccttaaaaaaaagccccagttccacaccaagccagtatcaaatgaatcgaaatctctggggatggggcttatctcccaaggctccccgaggtgattctgatgaacagtgagaaccaagaaccactgatccagaccttttaatccaagaactgaaaagtaaatgaccaaaggttagtatctcacacgctagttatataatcaaacatcgataaataaaaacaatctagtgttactatgtactgacattctcagttagggagaactgtgtttctagagaaaaaggagagctctattaacagccctttattggggactggccctgctagaaacagaatataacttcctgacaatctgatgaattagttcaaaaaaacttactacgaagttgacaacacctggagaagtcctatcaatcatcaagatagttagaacaatgttagtcaaagtagtacaaaaactgatgttcctcaacctaactcttactcactaggtctcactgaaagacctagcaggtagaagtggccaggtgtagtggttcatatctttaatcccagcactttgagagactgaggcaggcggatcacttgaggtcaggaattcgagaccagcctggccaacatggcgaaacccggtgtctatcaaaaacaacagaaatcagctaggcgcaagggcatgcacttgtagtcccagctattcaggaggctgaggcaggagaatctcttgaacctgggaggcagaggttgcagtgagctgagattgtaccactgcactcccatttgggcgacagagtgagactctatctcaaaaaaaaaaaaaaaaaataggctgggcggggtagctcacacctctaatcccagcattttggaaagctgaggtgggcggatcacaaggtcaggagttcaagaccagcctggccaacatggtgaaactccatctctactaaaaacacaaaaaattagctgggcatggtggcaggcgcctgtaatcccagctacttgggaggctgaggcagaagaattgcttgaacccaggaggcggaggttgcagtgagctgagaccgcaccactgcactccagcttgggcaacaaagcaagactccgtctcaaaaaacaaaaacaaaaacaaaaaaaacctagtaggacatgaaaaatttgatgggaacatacatgatttctgaaaaatacatcatttctgacttcctcaacaaagctttgagttcagtgacataggaaaaggcaaagcagtcttagctgaaatcatccttgctcttttcagaacataatcagcaaaactaacaagacagattaaataagtagaccattgaactctctcttaccttatgtgcaaggccaagccatcctgtaggctagagatccccaaatcagagagtgtatctgagccaacagaagcaggtgacaaggagccctccttctcctccagtaggtccaacttcaccaggttgctgatctcatcctctgagttatcttcagacacagaacctattatgaatcgagagtgctggttcagctccagaggttgggccaagggagatggttcatccattattcctccaaaatgagctcttacagctatggagaaaatgaaaagtgagaaaggcaggttatgaataataatctatatctgaggtcagccagaggttatatctaataaaccatagctgagacgtggaagcaaggcaatttgagaactaacttccttggctattctatttcagggcctttaatttctacaagggaggaaaattgagatcatgataactatgcccataaattaaaaccagttcccttttcctcaaagaaatttttctcaaaagcctataaggcattcctaatctcattttcatttggtggtgtccaggaaataattatgatcaatggggaaacctttgcagtaggaaaaagctgcttgttgtgatattgatattttggttgttagtaatgggggaataaatggtaagggtctggatagagtaatggttgtttgaaataatatttaaactacataatgctcatctggcttcaaacactatatattgagaggctataacttttattttattatttatttatttgagacagggtctcactctgtcacccatacagcatgcagtactacaatcatggttcactgcagcctcaaactctttgggctcaagtgatcctcctacctcagcctccccagtagctgggactataggcacgtgccaccatgcccggctaattctatttttatttttcatttatttatttatttatttatttatttatttatttatttagagacggagtctcgctctgttgcccaggctggagtgcagtggtgcgactgccactcactgcaagctccgcctcccgggttcatgtcattctcctgcctcagcctcctgagtacctgggactacaggcacccgccacaacacccagctaattttttgtatttttagtagagatggggtttcaccgtgttagccaggatggtctcgatctcctgaccttccgcctcagcctcccaaagtgctgggattccaggtgtgagccaccgcacccggcctattttttttttcttttttgagacgtagtctcactctgtcgcccaggctggagtgcaatggcacgatctcagctcactgcaacctccgcctcccgggttcaagcaattctctgcctcggcctcccaagtagctgggattacaggtacccaccaccatgcccggctgacttttgtatttttagtagagatggagtttcactatcttggctaggctggtcttgaactcctgatctcatgatccacccacctcagcctctcaaagtgctaggactatgggtgtgagccactgtgcccggtctaatttttaaatattttgtagaaatggggactccctatgttgcctaggctggtcttgaactcctgggctcaagcaatcctctcaccttaggctcccaaactgctgggattacaggtgtaagccactgtgcctggcctatgaattttacgtatgtgtatacttttaaaacaaactccagataggtaatttttaattaaaaaaaaaaaaactttacttgtcctcatgagttttttcttaaattatgcattttaaaatgtcaccccaaaatgactacttttggctctaatgtgctgacactgatatgagaagaaaatgaatctatcaccaaatttaaaatctataatcacctcaagtaagtataatttttctaaatgtagggccttaccagttaggattagatactgccaatagctaactaagaaactaattaacagcaaaccatcatgacacgtgtttacctacataacaaacctgcatgttctgcacatgtatcccagaacttaaaagtataatttaaaaaaaaaaaagaaagaaaaagaaactaattaataaagaccaaaacagcaacattcattctcttttatggaatgaagtgctgcccataaaaatttaaaaatattttttaaaaaccaaaataagagcccacaacaataaaaacccaaactaaatgaaacaatatttcttctgtcatctcaaaaatcctattttaaaatttcaaaactacagatcaactcagtattaaatagcttgtacccagatcaattattttaattcagaaaataagcctgggcgcggtggctcacgcctataatcctaacaacttgggaggcagaggcaggaggattgtttgagtccaggagttcaagactagcatgagcatcaaaacaagatcccatctgtacaaaaaaaaaaaaaaaaagattggccggacgcggtggctcacgcctgtaaataccagcactttggtaggccgaggtgggtagatcacctgaggtcagcagttcaacaccaacctggccaacatggtgaaaccccgtctctactaaaaatacaaaaattagctgggtgtggtaacaagtgtataatcccagctactcgggaggctgaggcagaagaatcacttgaacccgggaggcggaggttgcagtgagctgagatcatgcctctgcactccagcctgggtgacagagtgagactctgtctagaaaaaaaaaaaaaaaaaaagattaataattcccaattgtggaccttttagaggttcccttgactgatcccgacctcaacttgtatactgatggaagttcctttgtagaaaaaggactttgaaaagtggggtatgcagtggtcagtgataatggaatacttgaaagtaatgccctcactccagcaactactgctcagctggcagaactcatagccctcactcaggcactagaattaggagaaggaaaaaggataaatatatatacagactctaagtatgcttacctagtcctccatgcccatgcagcaatatggagagaaagggaattcctaacttccaaggaacacctatcaaacatcgggaagccatcaggagattattctaggctgtacagaaacctaaagaggtggcagtcttacactgccggtgtcatcagaaaggaaaggaaaggaaagggaaatagaagggaaccgccaaccagatattggagccaaaagagccgcaaggcaggaccctccattagaaatgcttatagaaggacacctagtatggggtaatcccctccaggaaaccaagccccagtactcagaagaagaaatagaatggggaacctcacggggacatagtttcctcccctcaggatggctagccaccaaagaaggaaaaatacttttgcctgcagctaaccaatggaaattacttaaaacccttcaccaaacccttcacttaggtattgatagcacccatcagatggccaaatcattatttactggaccaggccttttcaaaactatcaagcagatagtcagggcctgtgaagtgtgccaaagaaataatcccctgccttatcgccaagctccttcaggagaacaaagaacaggccactacccaagagaagactggcaactagattttacccataggcccaaatctcagggatttcagtatctactagtttgggtagatactttcactggttgggcagaggccttcccctgtaggacagaaaaggcccaagaggtaataaacgttcatgaaataattcccagattcggacttccccaaggcttacagagtgacaatggccctgctttcaaggctacagtaacccaaggagtatcccaggtgttaggtatacaatatcactcacactgcgcctggaggccacagtcctcaggaaaggtggagaaaatgaacaaaacactcaaatgacatctaaaaaagctaatccaggaaacccacctcgcatggcctgctctgttgcctatagccttactaagaatccgaaactctccccaaaaagcaggacttagtccatacaaaatgctgtatggacggcccttcctaaccaatgaacttgggcttgaccgagagacagccaacttagttgcagacatcatctccttagccaaatatcaacaggttcttaaaacattacagggagcctgtccccaagaagagggaaaggaactattccaccctggtgacatggtattagtcaagtcccttccctctaattccccatccctagatacatcctgggaaggaaactacccagccattttatctaccctaacggcagttaaagtggctggagcggagtcttggatacatcacactcaagtcaaaccctggatactgccaaaggaactcaaaaatccatgagacaatgctagctattcctgtgaacctctagaggatctgcgcctgctcttcaaatgacaaccagggggaaagtaactaaaatcgtaaatcccctggccctcccttatcatatttttctctttactgttctcttaccccctttcactctcactgcaccccgtccatgccactgcaccccgtccatgccccgtccatgccagtagctccccttagcaagagtttctatggagaatgcagcgtcccggaaatattgatgccccattgtataggagtttatctaagggaacccccaccttcactgcccacacccatatgccccacaactgctataactctgccactctttgcatgcatgcaaatactcattattggacaggaaaaacgattaatcccagttgtcctggaggacttggaggactcacttcactcataccagtatgtctgatgggggtggagttcaagatcaggcaacagaaaaacacataaaggaagtaatctcccaactgacctgggtacatagcacccctggcccctacaaaggactagatctctcaaaactacatgaaaccctccatacccatactggcctggtaagcctatttaataccaccctgactgggctccatgaggtctcggcccaaaaccctactaactgttggatgtgcctccccctgcactttaggccacacatttcaatccctatacctgaacaatggaacaacttcagcacagaaataaacaccacttctgttttagtaggtcctctttccaatctggaaataacccatacctcaaacctcacctgtgtaaaatttagcaatactatagacacaaccaactcccaatgcatcaggtgggtaactcctcccacacgaatagtctgcctaccctcaggaatattttttgtctgtggtacctcagcctatcattgtttgaatggctcttcagaatctgtgtgcttcctctcattcttagtggcccctatgcccatctacactgaacaagatttatacaatcatgtcatacctaagccccgcaacaaaagagtacccattcttccttttgttattggagcaggagtgctaggcggagtagctactggcattggcggtatcacaacctctactcagttctactacaaactgtctcaagaactaaatggtgacatggaatgggtcgctgataccctggtcaccttgcaagatcaacttaactccctagcagcagtagtccttcaaaatcgaagagctttagacttgctaaccgcggaaagcgggggaacctttttatttttagaggaaaaatgctgttgttatgttaatcaatccggaatcatcaccgagaaagttaaagaaattcaaggtcgaatataacgtagagcaaaggagctgcaaaacactggaccctggggcctcctcagccaatggatgccctggattctccccttcttaggacctctagcagctataatattgttactcctctttggaccctgtatctttaacctccttgttaagtttgtcttttccagaatcgaagcagtaaaactacaaatcgttcttcaaatggatccccagatgcagtccatgagtaaaatctaccacggacccctggaccggcctgctagcccatgctctgatgttaatgacatcaaaggcacccctcccgaggaaatctcaactgcacaacctctactacgccccaattcagcaggaagcagttagagtggttgttggccaacctccccaacagcagttgggttttcctgttgagaggggggactgagagacaggaataactagatttcctagaccaactaagaatccctaagactagctgggaaggtgaccgcttccacctttaaacaccgggcttgcaacttagctcacgcccaaccaatcagatactaaagagagctcactaaaatgctaattaggcaaaaacaggagataaagaaatagccaatcatctgttgcctgacagcacagcaggagggacaatgatcgggatataaacccaggcattcgagccagctacagctaccctctttgggtcccctccctttgtatgggagctctgtcttcactctattaaatcttgcaactgcaaaaataaaaatagaaaaataataattcccaattgtgattttgaagtgctctaagatatggtacattaatagataataaatgtattattaataactctgtatgctataactcactgtaaagtatgaaagtaagtggacaacagtgttccttgacatcagatgagaaaccgtcaatactttaaaatgtttgggaatcaccactcaacatgtgaaaattacatatgcacgattgttctggtgtaatttgtgagtcagtttactcacttacagagacaaacagcatttataaatgctagagtagtgtggttctcaaagtgtggtccctggaccattggcatcacctgggaacttgttagaagtgcaaatttcttgggcccttccccagaccaactaaccatatcagaacctacaggccagcatccattcatctatgctttcacaagccctaaaggttgagaatcactgtggtacaagaataaaacagtaattaacaaattggcaagactgctaaaacaaaactaaagaaaacctataccagcctgggcactatagtgagatcccatccctaaaaaaaaattttttttaattagctgcatgtggtggcatgcacctgtagtcccagctactggggaggctgaggtgggagaatcgtttgagcccaggagttcaagactgcagtatgctgtgatagcaccactgtactccagccttggtgacagagcaggaccctgtctcaaaaaaaaaaaaaaaaaagaaaagtaaagaaaactatagacatttcccttttttttagaggcagggtcttgctctgtcactcaggctagagtgcagtggcacgatcctcgttcactgcagcctcaaactcctgggctcaagcatcctccaacctcaacctccaaaatagctgggactacaggcatgcatcactatgcctggctactttttgtttttttgtacagacagcatctccacatgttgcccagcctagtctcaaactcctgagctcaagtgatcctcccaccttggcctcccaaacggttgggattatcagtgtgagccactgagcccagcctaacattttctgaaagtgaactggagattactttagctaacttctatctttaaaactagaatcagctgggcgcagtggctcacgcctgtaatcccagcactttgggaggccaaggtaggtggatcacaaggtcaggagatcaagaccatcctggctaacatggtgaaaccccatctctaataaatatacaaaaaattagccgggcgtagtggcgggcacctgtagtcccagctactcgagaggctgaggcaggagtatggcgtgaacccagggggcggagcttgcagtgagcagagatcacgccactgcactccagcctgggcaacagagtgagactccgtctcaaaaataaaataaaataaaataaaataaaataaaataaaacaaaactagaatcaaatataaaagtatgatgcaacatgagccaagatcaccactgcactccagcctggtgacagagcgagactccgtctcaaaaaaaaaaaaaaaaaaagtatcatgcaacaaaaaaaatttgctgtctaaatttactatacatttctcccttgaaatattaggtcttaaaaaaagttcaagatcagcctgcccaacatggggaaaccccatctctactaaaaatacaggccaggcacagtggctcatgcctgtaatcccagcactttgggaggccgaggcaggtagatcacctgaggtcaggagtttgagaccagcctggccaacacagtgaaaccccatctctactaaaaatacaaaaattagccgagcgtggcgcatgcctgtaatcccagctactcaggaggctgaggtaaggagaatcgcttgaacctgggaggtgacagagcgagactctgtctcaaaaaacaaaaaaaaacaaaaaacctttaaagggctcccattatttttggccaggcacagtcgctaatgcctgtaatacccagcactttgggaggccaaggtgagcggatcacctgagatcaggagttcaagaccagcctggccaacatggtgaaaccccaactttactaaaaatacaaaaaattagccaggcgtggcggtgggcacctgtaatcccagctacttgggaggctgaggcatgagaattgcttgaacccaggaggcagaggttgcagtgtgccgagattgcgccactgcactctagcctgggtgacagagactccctccgtctcaaaagaaaaaaaaaaaggaagaaaaaaggcagagagggagggaaaaggggaaaagggagggaaaaggggtaaaagggagggaaaaagaaagaaagggggagggaagggaaagttccaacagactgaccacactgaagaacaccaaaagttacagcagcaaaaagcctatttctttcacatttacagcagtaaatagttaagtttaaaagtaacagtagatccaaaaaataaaatcccatcccaactaacagaagataatgggtgccttcttcacaaagtaagaaagcaaggcactcaggtgcagattctagcttgcagtctgactgaagttagatgaccacacacaaaagagaaaatccacaaggcacaattctttgactccatgggagaagaaaaagagagttaataaaacacggttcctgggctaataagtgagagtctcaataaggccaacttcaagttcctagctaagaagaccatgaaggcagctttcactaaacggttacatagattggaggcaactcagtgtgaacagctaaaaagcctgtccagcaactgtactgaatagtatttcccaggcacgagcctacaaaccaacagaaaagagaggtcatgtatggaaaattactgagtagctgtccagacactctagaagctactccacagcctgtcccatttccactgattctagtcctgaattaaagagagaatacagttgagtaccattgttagactctttgttcacttcaggttatccaccctaaatctgcctatattattttgtggaagtcaacttttaacacaaaagcctacagtttgatattttacaacatgaacaaaatttttatcacattgtaaacaaggagtattatttgtaactgacctcttataattcttactgtctgagtagatatccacttccagaaagacctagagagaaaaagagagaaagattttaaggtttttttttttaagaaacaaacttttgtcaattcctgttttgctcagcataatacaaaggtaataatatatgaagtatctattttactggtcaaatctattatttaacttaaagcacaaagtttagcagtttattatttgttcaattctgtaaatcaaacacattacataaagactattgtttaagaaaatattaaacaatagaacaagcttaccatttcacaaggtggcttttccaattgtatactccatgaatacatttcaaaattttcatttctaatatttcatcaaaaaagaggcagtggggagaagagaaccactagattctctacaattcacttaagctctgattatgtttacaagcggttacacctacacacaaagattgggagccaggtggaagacagagtgcccattatactaagtccctaaactgtaagggatcaaacagtctctagcaactccccaaatcctcggtttccttcttaagcctgacaatttaaatctatctagggtagaaattctcaactctgattatgtttaagaatcacctgcggagcttttaaaaattttacaaagtctaaacaccaccctagatctgctgaatcagaattgcagctggagacccagggatatcaactttaagttccacagttaattgacactgatggaaatacacgcttgagaaccactcgttaagggcagagaagaaacaaaaggaaagaacctattacactggtagggaaatctaaaacttccgagaggacccctaaatgacaagggacaacatttaggaatattaggatttatccagttatgcagtctgagctagtattattccctacaactgagaagaggaaggaaaaagtttggatcatgtaaccaaagatgcagtgaaagtggagttaaaacctaggaccaatcaagctcaaactctgactgtcaaatattgcaagtgactgcagacttgaaggtcacttaacgtctctgtatatcatacagacaagcctcctcatctgtaaaaataaaaaagaaagtcttctgggcagtagtgtgcacctacagtcccagctacttgggaggctgaggcagaggtgtgctagagtccaggagctggaggctgcaatgtgctatgaccacacctgtgaaaagccaatgcactccagcctgggcaacatagcaagacccccatctcaaaaataaataaattaacgaatttaattaagtttaaagaaggtcatatgtacctcatgggactgctgtgaaaactaagaatatatgaaaggattttgtaaactataatgcaataggccagtgtttttcaaattatgggttaccacccagcaaaacattaagaaatcaatttagcaagttataaccaatattttgaaaatgaaataagatagaaaatgttaagatataccatagtttatgacagtatccatagttttgtaaatttttgtttcagttatatataggtcatgatgtaaatgacattttattatgaggtatgtcaaaaaaagtcttaaagcggccagatgtggtggctcacacctgtaatcccagcactttgggaggccaagatgggcagatcacctgagatcaggagtcaaaaccagctgggccaacatggtgaaacctcgtctttactaaacatacaaaaattagccaggtgtggtggtgtgtgcctgtaatcccagctactcaggaggctgaggcaggagaatcgcttgaacccgagaggcggaggttgcagtgagccaagatcaccccactgcactgtagcctgggcagcagagcaagactctgtctcaaaaaaaaaaaaaaagccttaaagccacaactaatccttactccctcaccccctccactttataacctcactagacagcaaagacagccagttaagtacataaaccaacgattcttaaaagtgtctcaactgttggaaatttgatgaaagctatggaccttttcttgacaaaaatgtaccctcatacaaaattttcattccatacaggtttgggattcctaaactcctgccctgaattaggttaagacctctttctccagaaagaggactaaaaaagaagctgacctttggggaaggctcatataattgctgtcttagttctgaaacaaggcctttttccagatccagtctgcctactcaaataaaaattattttcttcattatataaaattgttgacaatgccaaattctcttttatttaaaaaatatatcatgtggccaggcgcagtggctcacacctgtaatcccagcactttgggagatgaagacgggcagatcacttaaggttcggagttcgagaacagctggccaacatggtgaaaccccgcctctactaaaactacaaaaattagccaggcatggtggcagacacctgtaatcccagctactggggaggctgaggaaggagaatagcttgaacccaggaagcggacgttgcagtgagccaagaatgcaccactgcgctccaggctgtggacaaagtaagactgtctctcaaaaaaaaaaaaaaaaaaaaaaaaaaaaatatatatatatatatatatacacacacacacacatatttttaaatatatatgtattttaaatacatatatatatcctatatatacactatacatataatgtattattcagcttttatttggagactcttgaaaatttttgcggaaggctcccaaactgtgccttatgttcctgaaaatgtggtaaagctaattacagctaatgtatttaagagtcagcctgggccaggagtggtggctcatgcctgtaatctcagccatttgggaggctgaggtgggagaatcccttgagtccaggagttcaaggccagcctgggcaatatgacgaaaccccatctctaccaaaaaaaaaaaagctggatgtggtagcacatgcccatggtcccagctacttgggaggctgaagtgggaggatcacttgagcccagaaggttgaggctgaagtgccactgtactccagcctggccaacagaatgagactttgtctcaaaaacaaaaacaaaaacaaaaaaagtcagcctgcatttcattcagaaattttttttttctttttattgagacggagtctcaatctgtcacccaggctggagtgcagtggcacgatctcagctcaatgcaacctctgcctcccgagttcaagctattctcctgcctcagccttccgagtagctgggattacagatgcatgccaccacacctggctgatttttgtatttttagtagagacggcgtttcaccatgttggccaggctggtctcaaactcctgatatcaggtgatccacctgcctcagcctcccaaagtgctgggattacaggcgtgagccactgtggccggcccagagatatttttctaaataaatacaacagattttaccaaatttagttagcatattctccttgaactcaaattacactgtattttccatgcaattctaataaagaggcagcaattagttttcatagccactgataaaagtatccaagcttttacaacatgtccttgcctctcaagtcatagtaagttcacttaaatgttttcaaagaggccgggtgcagtggctcatgcctgtaatcccagcactttgggaggccaaggcaggtggatcacgaggtcaggagttcaagaccagcctggtcaagatggtgaaaccccatctctactaaaaatgtaaaaattagccaggcctggtggcgggtgcctgtaatcccagctacttgggaggctgaggcagagaactgcttgaacctagaaggcagaggttgcagtgagccaagattgtaccattgtactccagcctgggtgacagagtgagactctgtctcaaaaaaaaaaaaaaaaaaagttttcaaagacaataagtgaatttgccttgttcactttgtcatttattttttaatggattttggttattaattcagtgattcataaaaggattacagaaaattttattttaaaaactattttaatttaccacaagttttaaattttaaaataacaagaacttgtgttccaaatagtgaaacagatgctgattattcaaagataaataagatttgtccctagctaagtggctattgacacctaaatatacaattacagtagtataataatctctgaaaacacaaaaaatataaacaaaaaaataaaaagataaaaaataaaaaagaaatttaaaaatttttttaaaaagaaaaaaaaacctctaggccaggtgtggtggttcacacctgtaatcccagcattctgggaggctgaggcaagaggatggcttgagcccaggagtttgagaccagcctggacaccatggcgaaaactgtctgaagacagtgggttgggccgggcatggcagctcacacctgtaatcacagcactttgggaggatgagacaggctgattgcttgaggtcaggagttcgagaccagcctggccaacatggtgaaacccagtctctactaaaaacacaaaaattagcggggcgtggtggtgtgcacctataatcccagctacctgggaggctgaggcaggagaatcacttgaacccaggaggcagaggctgcaatgagctgagatcatgccattgcattccagcctgggtgacagagcgagactccttctcaaaaaaataaataaaaataaataaataaataaactaaaaaggcataacccacaaaaagaccaaaaaagaaattaaaaagtctgggtagacaacaagacaattttcttggaaagcagacagaagagcaataaatgactaggcaagcccaagaaaactgaatcatagcccaactgtggtaaacttacgatcaacacaatttatgtcatacgttccccaaaatgttcagaaagtggaggtgaaagagagctaaagaaaataaggaggattggttgaaattgtttccgaagcttcagatcattacattttctccccaactagtgaagtcaggtgcctgctgctctaccatcctgagactttaggtttattctctagagagggttaaacagagggtttctagattgggggataccagcaacagtaaggggcagggtacaatactgaaaataaataaattaagtcaatatattgagtaagattttccggtcctctttccctaatcgtcaccttcccggagagagattagaggatccttcttgcccaggctggagtccagtggcatgatctcggctcaccacaacctctgcctcccaggttcaagagattcttctgcctcagcctcccgagtagctgggactacaggcccgcaccaccattcccggctgatttttgtatttttagcagagacggggtctcaccatattggccaggctggcctcgaactcctgacctcgtgatccacctgcctcggcctcccaaagtgctgggattataggtgtgagccaccgtgcccagcctagaggatccttcttcggagaatctgaccagctcaaggagagaaaaataactaaagttactaacatcaacgtccctaattgagttgcccaaccagattacactgtagtaagctaaccacctctaatcagctttcaacacttcctcttaaatataaacagacaataaagattaccagatgtctgagaaaaacttcaacatgaaagactaaaaacaaataactacctgtagattaaaaaaatgcaacttgaagaaaagagattacagggaacaagaaaccattaaaaactacaggggtcgaggggaggggaaagcaacttcacctctgcggtattttcccaaaaaacccataaccctagtttaatcatgagaaaatatcagacaaatttgaattgagggacattctataaaatacttgatgagtactattcaaaatcatcaagccattacaaaaatggaaagactaagaaactatcacagatcaggggagattaatgagacatgaccactaaatacaatgtggtatcctacattaaatactggaatagaaaaacacatcactaaaaaagaaaagctacagaaggccagcatggtggctcatgcctgtaatctcaacactttgggaagcttaggcaggaggatcacttgaggttaggagtttcacattacaatgagctataatggagcccctgcactctggcctgggcgacagagagggaccctatctctagaggaaaaaaaacccaggaaatacagttttatagtttagttactattgtaccaatgttaatttcatagttttgactaaagtattatggttagccgggcatggaggcatgcacctgtaatctcagctacttgggaggctgaggcaggagaatcacttgaacccaggaggcggaggttgcagtgagccgagatcatgccactgcactccagcctgaccaacagagcaagactctctctcaaaaaaaaaaaaaaaaagtattatggctatgtaagatattaacaattgcctacttgagggtagcagatgggagggaaacgataagaaaaaatatctattgagaccaggcgtggtggctcactcctgtaatcccagcactttgggaggccaaggcaggtaaatcacgaggtcaggagatcgagaccatcctggctaacacggtgaaacccagtctctactaaaaatacaaaaaaattagccgggcgtggtggcgggcgcctgtagtctcagctactcaggaggctgaggcaggagaatggcgtgaacctgaaaggtggagcttgcagtgagccgagatcacaccactgcactccagcctaggcgacagagcaagactccatctaaaaaaaaaaaaagatttgattgccctgctagattatggaattgcatggagcctgtagcccctttgttttggacaatttctcccatttggaatggctacatttacccaatgcctgtatttccattgtatctaggaagtaaataacttgcttttgattttacaggctcataggcagaagggacttgccttgtctcagatgagactctggactgtggacttctgagttaatgctgaaatgagttaagactttgagggactgttgggaaggcatgactggttttgaaatgtgagaacatgagatctgggaagggccagcggctgaatgatatggtctggctgtgtccccacccaaacctcctctttaatttccacgtgttgtgggagggacctggtgggaggtaatcgaatcctgggggtgggtctttcccatgctgttctcgtgttagtgaataagtctcacgagttctgatggttttaaaaacaggagtttccctgcacaagctctctctctgcctgcttccatccatgtaaaacatgacgtgctcctccttgccttccgccatgattgtgaggtctccctggccatatagcacagtaagtgcattaaacctctttcttttgtaaattgtccagtctcgagtatgtctttatcagcagtgtgaaaacagactaatacaagggctcaagtgatcctcctacctcagcctcctgagtagctgggactacgcacacactaccacacccagctagcttttttgtgatttttgtggagacggggttttgttatgttgcccaggctgatctcaacctcctgctcaagcgatcctccagcctcaacttcccaaaatgttaggactgcaggtgtgagtcacaacagctggtctgaaatatttttaaaataactattttaggccaggtgcggcggctcgcacctgtaatcccaacactttggaaggctgaggcaggagggtcgcttgagtccaggagttccagaccagcctgagcaacaaagcataacgccatccctacttacgtaaaaaaaaaaaaaaaaaagaaagaaaaaaaattttttaacaagaaagaatttttaaaagctaaaaatatgatcacagcaatgaaacaactcagaagataaggttaaagaaaagctttcacaaatcagaataaaaagtcaaagagggccaggtgcggtggctcatgcctgtaatcctagcactttgggagggcaaggtgggaggatcacctgaggtcaggagttcaagaccagccttggccaacagggtgaaaccccaactatactaaaaatgcaaaaattagccaggtgtggtgctacacgcctgtaatcccagctacttgggaggctgaggcagcagaactgcttgaacccgggaggcagaggttgcagtacccaacctgggtgactgagtgagactctgtctctcaaaaaaaaaaaaaatatttaaagtgatgaacaacaggagagaaaaagaagatgagagaacctgttcagaaggtccatatctaagtaacagaagctcccaaaagcaagaacaaaacaaagggcaaaaattttaatctgataatcatgccagattgccatggtcattgccagattaaaaaggcccaacaagtgcctaccataatgaataaaaagagacaccaaggcacatcactgaaatttcagaaactgaacacaagaaaagatcctacaagcttcctgagagaaaaaagttcacatacaaatgatcaagaatttgaatgcctttcagacttatcagaaataacaacagaagcttgaaggttattaaacaatgccttcaaaattctgaaggaaaattattttcaatctagaattttagacacaataggttgctgatcaattgtgaggacaggacatattttcagacagcaaaatctcaaaataattacctccgataatgatgcaattagaaaacataattcattttacaaacaccaatgctatacgggcgtggtaattccagcactttgggaggcagagacgggcggatcacgagatcaggagattgagaccacggtgaaaccccgtctctactaaaaatacaaaaaattagccgggggtggtggtgggcacctgtaggcccagatactcaggaggctgaggcaggagaatggcgtgaacccaggaggcagagcttacagtgagccgagatcgcgccactgcactccagcctgggcgacagagtgagactccgtctcaaaaaaaaaaaaaaaacaccaatgcaataactgatgttggcaaatatcgtaaatatatgttaaaactattggataaagggttttcagaaaacaacatattctttattatttattattattattattttttgagatggagtctcgctctgttgcccagatgtgagtgcagtggcgtgatcgccgctcactgcaacctccacctcccagactcaagcaattatcgtgcctcagcctcccaagtaactgggattacaggcgtgtgccccaacacatggctaatttttatatttttagtagagatgaggttttgccacattggccaggctggtctcaaactcctgtcctcaagcaatccatctgcctcagcctcccagagcactgggattacaggcatgagccaccatgctcagtgaaaacaacatattcttacatatatatatatatataaaacatatatataatatatattatatatacatatatcttacatatagataagatatatcttacatatatattttacatatatacgtatataagatatatcttacatatatatatcttacatatgtgtgtgtgtgtgcgcgcgtgtgtgtgtgtatatatatatagcttttttttttttttgagacagagtctcgctctgttgcccaggctggagtgcaatggccagatctcagctcactgcaacctccgcctcccaggttcaaacaattcttctgcctcagcatcccaagtagctgggattacaggtacccaccacttcacccagctagtttttttgtattttcaatagagacaggattgcaccacgttggccaggctggtctcgaacttctgacctcaagtgatccgcctgcctcagcctcccaaagtgctgggattacaggcatgagccactgcacctggccatattcttacatattaattacaaaagggaaaagtatctttacaatggagaaatctgatggataccatcttaactaagtattcaaactaaatatcaccaatattaggaaaaactgacatccttgtatgatgtgtgtgtggtttactctgtgtgtgcatcactggatgtgatgcaatagaagtatacaacaggctaggcacagtggctcacacctgtaatcccaacactttcggaggctgaggcattacgactgctcaggagttcaagaccaggctgggcaacaaagtgagactccgtctctataaaaaataaaaaaattaaaaatttgctaggcataatggcacgtgcctatggtcccagctacacagaaggctgatatgggcggactgcttgattccaggaggtcgaggctgcagtgagccataattgcaccactgtactccagcctgggcaacatagtgaacccgtctcaaaaaaagaaaaaaaaaaccaaaaaaaaaaacccagaaaaaattagctgggtgtggtggcacatgcctgtagtcccagctacttgggacccttaggtgggaagatcacctaagcccaggaggttgaggctgcagtgagccgtgactgtatcactgcattccagcatgggcaaaagagcgagaccctgtctcgaaaacaaaacaatgaacaaacaaaaaaatgtgtttcgggctgggcgtggtggttcgcacctgtaatcctagcactttgggaggccgaggcaggtagatcacctgagattgggagtttgagaacagcctgaccaacatggagaaaccctgtctctactaaaaatacaaaattatccgggcatggtggcgcatgcctgtaatcccagctactcgggaggctgaggcaggagaatcgcttgaacctgggaggcggaggttgtggtgagccaagatcaggccattgtactccaacgtacatggcccccttttgtgcttttaaaatgttgaaccaggccaggtgcagtggcccacgcctgtaatcccaacactctgggaggccgaggtgggcagatcacctgaggtcgggagttccggaccagcgtggccaacatggtaaaaccctgtctctattaaaaatacaaaaattagaggggcgtggtggagcgtggcgcatgcccataatcccagctactcgggaacctgaggcaggagaattgcttgaacctgggaggtggagattgcagtgcgctgagatcgcaccgctgcactccagcctgggcaacaaagcaagattgtctcaaaaataaaataaaataaaatataaaataaaatgttgaaacaggctgggtgcggtggctcacgcctgtaatcccagcactttgggaggccaagaccggaggatcacctgatgtcaggggttcaagaccagcctggccaacatggtaaaaccccatctctactaaaaatacaaaaaattagctgggcatggtggcacacgcctgtaattccagctacatgggaggctgaggcacgagaattgcttgaacccaggaggcagaggttgcagtgagtcaagatcctgccactgcactctagcctggggtgacaaagagtgagactctgtctcaaaaaataaataaacaaataaaataaaatgttgaaccacatgaatgtattgccaactgaagattttaagtaagtttaataaaaagctttcctcaattaattccatgctactctgatcccttatctcatatctgtcagaggatttagccagacaactgaaatgttattcacttatttctttaatatgtgttactatgtaattgactctgggttatctcctagatgaggctgggaaaagttatcctctcttccaaaaacaacaaaaaggagagaaatggaggtcttgctatgttaacgaggctggtcttgtactgctggcctcaagcaatcctcccatcttggcctcccaaagtgctaggattacagatgtgagccaccgtgcccagcctcttctaattgttttagatccaccaccctcaatgcctcacaatgctgtgtaaacaccaggctttcacaggctgcattttttttttttttttttttgagacagagtcttgctctgtcacccaggctggagtgcagcggcgcaatctcggctcactgcaagctccgcctcccgggttcatgccattctcctgcctcagcctcccgagtagctgggactacaggcgcctgccaccacattcgtctttttagtagagacaaggcttcaccatgttacccaggatggtctcgatctcctgaccttgtgatctgcccacctcagcctcccaaagtgctgggattacaggggtgagccaccgtgcctggccaggcttcatgttttatcagaattgcaacgaatatttgagttacaaaactaggagacataaactaagtcgttatttcaaacattatcctctagaaacatttaaaggcctccaggtaaaatgccattttgtgaattcagaaagttctaggatgaattaatttacgctcgtaatcttatttcatagagctgcatttagagaaaaccagagtctcaaggaaaagaactggctcatggctgtataatctcaacactttgggagcccgaggcaggaagatcgcttgagcccaggagtttgagaccagcctgggcaacatgacgcaaccccatctctaccaaaattaagaaaaaaaaaaatagccaggtatggtggtgtgtgtctgtagtccccgctacttgggaggctgaggtgagtggatcacttgagcctgacaggttgaggctgcagtgaggctacagtgagccatgactgtgccagcacactccagtgagggtgacagagtgagaccttatcaaaaaaaaaaaagaaaagaaatttcttccttaaggaaatactgcttattttttttgccttcaagtcctacggatgtgttaaggcattatactttatattacctaacagagatctatgctggagacatttacaggttaaagcaaaaattcctaattcctttgtagctacaacatcctatgcagttttagggaggcagttttaagttgaaaattatgaagaactcccaaaaatcagttgccccgtgatgccttaagccagatgtgcctatcgttggaaactttcaaacgtacatcagataaaatattctctcatattaagtggaaaactggaaaagaaaatcccttaggtactttccagtactaaatgttctattaagttattgaattttgagatagaatcaaagtaaaattaaacagcttgccttgccagggccaggaataccactaaatgctaaagcataaaacaggacccagcaattcattttcttgctgctaatctactgatattactcctaataaacttaaaaactaatcaagctcctatcaacctactattccaaatcttggcatgtgtgtaaaatatatacacaactaagaacagatttgaaaaatgcttataaaaaaagaagataggctgggcacggtggctcacaactgtaatcctagcactttgggaggccaaggctggcggatcacttgaggtcaggagttcaagaccagcctgaccaacacggtgaagccctgtctactaaaaatacaaaaattagccgagcatggtggtgtgcgcctataatcccagctaatcaggaggctgaggcaggagaatcacttgaacccaggagaaggaggttgcagtgagctgagatcacgtcactgtactccagcctaggcgacagagcaagactccgtctaaaaaaaaaaaaaaaaaaaaaaaaaagataattttacaggaacttcattaagagtattatactctatttctatcaaaggggataaccaaatattcataaatgaggccttatatttcttgagaaagactccccaaaactgagtctgtttttttaaacttcatgagttcattcggaattttccaactttgctgggcatggtggctcatacttgtaatcccaaaactctgggaggccaaggcaggaggattgcttgagcctaggagttcgaaaccagcctgagcattacactgagacctcatctctacagaaaattaaaaaattagctaggcatggtgacatgtgcctgcgatcccagctactcaggaggctgaagtgggaggatcgcttgactccaggaggtcaaggttgtagtgagccatgtttgcaccactgcactccagccgggatgacagagagagaccctgtctcaaaataaagaaaataatttatacaattttattctatctgaaataaccactccataaatagtactgccatgcaatttccagtcctgatgtcatggaatggtaaacattattgtggttccttatataaaacagcatgagtatggcatgctaaaaggatggaatgagtctaagtctcaacatcatcgaaaggcaagaccaactggggccaccaacctttaggcagggcactgaatagcccttgctgaagccacttttcacttgcctccttaaacatcctaagactagacagcccaatggtaacttgaaaaagtaacaaattagtaagagaactgcatcattagagaacacttaaatgagattggccagctaaactcataagaattaatgccatatcaatcagatttatacagtgtaagtgcaacatccttatgacactatttgtcatagtttcttacctgtttaatatcaccttcaaatagtccattagattcaagcgaatacagtactcattacagttttttaaaattaaagaaacaggctgagtgcaatggctcacacctataatcccaacactttgggaggctgaagtcggaggatcacttgaagccaggggttcgagaccagtctaggcagtaaagcgagacccccactccaccccacaaaaaaaatttaaaattagctgggcgcagtggtgtacacctgcagtcccagctactccagaaggtaaggtggaggactgcttgagcccaggttgaggctgcaatgagcaatgatcacgtcactgcactccatccggcctgggtgacacagcgagagaatctctaaaaaaataataaatcaaaaacacttaaaaataaaggccaggcacagtggctcatgcctgtaatcccagcactttgggaggccaaggcaggcagattacctgacgtcagttagagaacaacctggccaatatggtgaaaccccatctctattaatatacaaaaattagccaggcatggtggcatgcgcctgtaatcccacctacttgggaggctgaggcaggagaattgcttgaacccgggtggcggtggttgcagtgagccgagatcacaccactgcactccagcctgggtgacaaagtgagactccatctccaaaaaaataaataaatacataaaaaataaagtggccaggcgcagtggctcacacctgtaatcccagcactttgggaggccgaagtgggtggatcacaaggtcaggagttcaagaccaggctggccaacacagtgaatccccgtctctactaaaaatacaaaaatcagccaggtgtggtggcaggcgcctgtaatccgagctacacgggaggctgaggcaggagaatcgcttgcacatgggaggtggaggtcacagggagccaagatcacaccattgcactccagcctgggtgacagagtgagactctgtctcaaaaaaataaaataaaatagccaagcacggtggctcacgcccataatcccagcaatttgggaggctgaggtgggcagattatccgaggtcgggagttcgagaccagcctgaccaacatggagaaaccccatctctactaaaaatacaaaaaaattagccaggcgtggtggcacatgcctgtaatcccagctactcgaggggctgaggcaggagaatcgcttgaacccgggaggcggaggttgcggtgaaccgagattgtatcattgcactccagcctgggcaacaagagtgaaactctgtctcaaataaataaataaataaataaaatggaggccagatgcggtggctcacgcctgtaatcccaacactttgggaagatgaggagggcggaccacctgaggtcaggagtttatgaccagcctggccgacatgacgaaaccccatctctactaaaaatacaaaaaattagccgggcatggtggtgcacaccttgtagtctcagctactcaggggggtgaggcaggattgctagaacctgagaggtggaggttgcagtgagccgagatcgtgccactgcactccagcctgggcaaaagagcgagactccgactccaaaaaataataaaataaaattaaattgaaacaagcaaaaaaccagttaataatctgttaataatctgttaaagtagaagattaatggtaattatctcaatagttaataggaattttttagccaatgagtctctactgtttattcgcttttttgtaatcttactgttttacgggtttggaaagatacttgacacatagctcctataattattattattattatttttttgagacggagtctcactctgtcacccaggctggagtacagtggcgcaatctcagctcactgcaagctctgcctcccaggttcatgccattctcctgcctcagccttccgagtagctgggactgcaggtgcctaccaccacacccagctaattttttgtatttttagtagagacggggtttcactgtgttagccaggatggtgtcgatctccagaccttgtgattcgccagcctcgacctctcaaagtgctaggattacaggagtgagccaccgcgcccggcagcttctataattgttaatctttaggaacatgttagataatgagataacttttttttctgaattacaaaaggattctcttctcctcccacaattgaaaatactaatttctaatgcattattccacagtttgtattttaatttacttctttcctcaactaagactattaggatattagccatccaattaaaggaaaaaaagattttaaagaaagaaaaacactagccctaaacctgttaaaccagtccacgtgacaggtataaaaattttcctagtcattgactgcaaaggaaataatgttacatagtgatctacacctgaacctgttcacagcactttagagaggtcaacatcagatgagagagcgttctctgaggctggctttcacaataccaggtcttcagcattacctagtttttgaactataaattcactaagataaatgccaccatttcccaagacttcctttttaaaaagcaatttaatcttatgcttgatgtatttctattatgcactggtaaatcaaaacaaaacaagcctggcgtggtggctcatgcctataatcccagcactttgggaggccgaggagggtggatcacctgaggtcaggagttggagaccagcctggccaacatggtgaaaccctgtctctaccgaaaatacaaaaattagccaggcgtagtggcgcacgcgtgtaatcccagctactcgggaggctgaggcatgagaatctcttgaaaccaggagacgaaggttgcagtgagccaagatcgcaccattgcactccagtctgggtgacagagcaagactccatctcaaacaaacaaacaaaacaacaacaacaaaattctacaacactagtaaacacagatggcttcataaattaatactttacctttggcatctttcatatgcccactttaaaatgtttaatattcttgggttcacatcagtcctcctgttatgcattcagttttactgagaaatgaagaaactgaggcaagagaagtgggaaaaaacttgctatttgtagcaagcaggcatctatctggacaggtaaactgtggtcctgctctattaggccacaatgcttttctgaaaagtgcctgtcaaataagcaccacagaaatccttctcatcacagacatccagggcatccccctcaagaagggacaaatatgagtattcttccctgctgagtgagaaaagaccatgtaaccaaagaaagcatgcttctcaatctatactaccgaattgggagggaaaaaatgaatggaaagagagagaaaatccaaggaaataaacttctgagactgaagatgtggttattaggtttatccacacattaggaaattactgaaacatcgcttaagtagaaacagaatcaggaaggcctagggtctttttttttattccagtcttaaacctccaaacaaaaatatctgaaattaaactatttctcctgagcagttatattcttaaatgtctctatagaacccacaaggcctacacgaagtccctgatttttagaggtgatttcaagtgtccattagtgtccactctcccactctcaaatccaaaataatgttggccccgatccgggcaggaccttcacgcacattttcctgtgaaatcattagcttcacatcagcttcctacgtcctatttccagtaacttcccttgatcagcatggcaaacgaggagagtaacaaaaggcatgtacatttactatgtccctcgcagagaacataataaaatcctgggaacaggaactggcagatacaacctgcctggccctggctctcgccacgatacaaaggcacggagagagcaagtgaggtctgcaccccacacctcactctgcaagagagaaaggactttcaatgcaatcagacccaacccgcaacgcccccttcccacgtggtcttctccctctcccgagcccagaatcggattggagaggggtctggaaggaatcagaccacgctggagctgggcaagaggggtggcgggcgagctccaggcagaaactccagccccccttcctagaggagccctgaactgtacgcctcccagttccgggatctgaatccccacctcccgagaccccagacctctccatgtctctagggaggggacctcaaggcctcagagctgcgggaagggctgggctgccccgcacccgatctggatagtgtggagcccaggccgcgtgcgggtgagcggaggctgggaggcggccccctgcctgccgccgcccctcccttggccccagtttctccaggtccccggtcacaggttctgggccggccctcacctcacctcagggtggcaacgtgtgcggtcgggcgattccggagcccctgcgtggaggaactgctgggcgggaggagacgccggcggctcgggcgatggctgacaggcgtgcagcaccaggccg

SEQ ID NO: 1160 - DNA, 214766 bp, Homo sapiens
tcttctacaaatgtagaggtttatttcaacaaaatgtgtaaagagtgcatctgaagctcctgctcatcacagtatgtgtccatcaaattctgagacaagtgaaggctgttttgtgaacgaagagaacagataatatggcggtctccgtccaagcaggtcttggtcaatatccatcatttatactcctcctgccttagtagccttgcatgtttgaggggctgtgggaatgtcagattgctcatgttctgtgcctccaacttgaaaaaatccttgtccagggtaagacctacagtaaggagctctggggatgggggaggaggcattacagggttctagagaggaaacatactcgtttgtgtcataatttggtggggagaggggaggtaaatgagtgtaacccaccctgcctctgaagacatgcctggacaggcctcctggggggtgcaggacttcataccacttgtagatatgtgggatttgatttattgcaaaaaagcatagaagaataatctggtcaaaaatgaatccaattcttactaggtaagcaaatagccagcaatggtcaatgcattttcctggactgagaattgtcccccaccactttatgcccttttctgaaggtgctgaacacctgtaccttccaccagggcagccgggctgaggctctgactcctgggggctgtccgctccatacccagccatacagtgcccacctgcaacccagaaccattgaaaagtccagccaatctatccgcacagattcctcctgaagaaggggaggtggagctcgttcttgtgtgcaaactacagggttaaggctcagaactgtggcttgtccaagaacgttcataccactgcttctcaaatgtcttagtgatttcctccttggtcatcagtgacaaatgcagttagctgcactaaaggaaccggatgctacaccagccctgatcacctgccactcttgctttaggaacagaggaatcagtaagttcttttcttgaataaactagttgttgaaagtaaactctctccaccacctgaggaagcccctgatgccagtcaggaggggccagtaagcctggaggacagcagcaccatgactgagttgtaaataatcttaaggtcatgtggattctgtgtttcctggaagcctccctcatcaggaaggccagctcctggtgctgagggtgtagctgtcaccagggtcctttcagagctgtggggagacctgctgcctgtctacactctggggaagagagtagaaccgttagctgctaggacagtaatcctggaactagggaagagtgagtgtggaggcaccattaacctctcaaaaccatccaagctccaggcttcataggaacaactttccaagtcctcaaaacaaacagactatctatctatctcactggctctccacatggcataaataactagtttccaccagtgcagaaagggcagttctcttctggctcctcctctgccaactcaggcttcaccacctgtggaactgctggggcccctcaagcactggccttgcagctcccagccacatgcgacagctagtccagcagtgacgtgcaggcgagaggcaggccaacaactacctttccctttgtcctcagagactgaacccaaggttgaggtcccctaaatcaagaataactggttctattttctttctctgcttcttggctcacagttttgccctcatctttgagttcctatggagcttgtagtagattttatgctctaatttttcttcataaaaggtaccgtagtgtggttaaactgggaatcattcctctccagtgcctactgtgtgctgggctaagagtcggggtaataaacaatggacttgaggcttcctcctctccttagccctcctctgctgcctgtggctgcggctcatggggccaggagtgaggggggctgctcactgctgggcaactcctcacgcttccccatgctgggaggccaaggggctgtcaggacaggaggggcagccctactttggttagtaagacctcatggtacatgtttgtacctttcattgccttctcagtcctgtgcagggagtggaggactaggcctggccagggtaataaatactgaatggggtaggtgtgactggtgggctggagggggattctgtgatcttacatcccaggatgtcatgcataacctgaaacgagaggaagtaaaatgccatttgactccagtgctgggtctcctgtgccttctcattacagtggttacagttgtaaaaggcagctctagcccttttctccagagacagggcagggacaggcaggaagctcttcctacgtggaaggggaatccattgtggagaggatccgtatgacttctgctcgctgagtgggtgatatgtgctgcgtcatatggatgatggaatccatggcaacctctggattggcctggaccaagctggaaaggaagattgagaatggtgaagaaaagagaagcagaagtgtctagatgaggacagctaaagaactgcccaataaacatgtgtgcaccgtccactgcagacattttagtcacgcctcaccttatttgtttccctatattacaaatatccagccaaggtagtgcaagacaaacccaaaacattttgctatgttgaaaaaggaattaaacccaaaacaaaacccaaaaaaaacccaaaacatgccaatgggggcatgtcacaaagacagcaattggggcatcaaaagcagcccagcaatgaattataaatcagtaaaaaatagaacttcatgagtctgtaccaataatgtatatataaaagaatcggcaggagtgaggactgagtggtgactggtaattgtggagggtgtgctggagttggaaagttatcattttgcaagctcatcgtaaagactgcaccagagggaaattttgatgaaagcaagatacttgcatggccttaaaatgtcttcctgcagactacttattaggtgcaaggggggaaaatcagtaattatacggtagagaaatggagcaacatcttgaccagcggatgaaattaacacgaggaggagcagataaacagcatgtgcccccagatgtggtgccctgtgaaggttctggccagagtgcctcacctgcatctcatcatggggagacatcagacaaactcaaaatgagcaatgttctacagatggtagatatcagataaaagtttttaatcaatgttaaatttacaaaagtggatcattttatgatggttatgtaaaagtatccctattctcagcaaatgcacactgaaatatttgggggtaaaggccatgatatatgtaacacccttaagtagttcagaaagaggaaaaatgtatacacatatgggagggcaggcacactcataagtgatatagcaacggggagaaaatgtaacaggtaaatctgagtacagatattatatataggggtgttctttgtactgtttttaattttataacttttctgtaagtgaaatgtttccaaataaacttttacaaaaatgcccctgcagtctctaccaccgatcctatggagcagactgaagcctctagaagaatacagctaactcttggcttcaggaggtgaggaggtggtttcccaggaaaccaccacacacacaatcagctttcctcccagagttgttcatccggtttgagtatcagcattcagagctaagaggtgggcacagtgaattaagccttcatctagctgagattactaagtgcccctggggagcagtagctgaaaaagaattgggcttcaggccatatctgtacctgtgggtcaactacagctgtctcaaacagcaagagactgcagagatcataagatttctgcgatcatctcatgatttgtttggaaactttttattccaaagaaattagccctccttctctagtggagttccccacgttggtctcacctgcggatttgcttgaggacgtagtctctgctgatgcatttgatgttttcctctattaccgagtgaacaccatcctcctctgtcagctgtttctctagccactccgccagatccttattattgtcccaaacataagcctgcaaacagatgactcttggtcaaacaccaggggtcaggccaggccgggacaccctgactattcaggatctggagtgcttgcttactccaaaagtgtgctccgtgtccacgattctccttcactgtcagcatcgtgcaggaggaggaagtaggcctcgaggcaggagctgtgccccttctccttctcttcctttatggacacaggtgtacacctgaagtctccatggggctctcccgagcactctggtgctcataccctgactctgtcctgtcagactctagggacccacctatttgacaaaggctaagagaattcaataacctgacaggtttgagagaaccagttaaaagcccaaattacttagtaaaattgtgattgagaaggcaaggctgtttatttggtgttttgctctcagaggagctgagacacaatgcctaaagtataagtctctagcctcagtgaggcctggcagtcactggatggatgaagtctcctgaaatagagcccactgtcttttgatgaggcacggacggggaactgatgggagggaagtcttgttgccagggtacagccaccaggtcagaaacctaagccccattttattacctatgagagtattcgaaaggatcaagacgtccataaccctgaaagtctcaacaaaccacctctcacctccttttcaagatcatttagctgagtatttcctaggtggttgactacataataattcaggagtgtgttagaagcctaatagccttctccttgctctcttctcctctcattttctttacaaatcatttaggaatcgttttgttaatggtttccggaaaaccaagtaccacaattagggctcattcatatttatgtcattttgtttgggtaattaaacacaaagcttgtcatttaaaggtgcgctatccttctctgttatcactaacgaagtcaaagtcagaatgacaatgagtttggtgctataatttaataggtgggtgtgtttgttagggactctgaggctttgaggtttgagacgtggctacaggaagcctgtatgcaagcaaggtcaccaaagccacagctgtgactactgggctgcagaggaaatgtcttcatcacaagaggcctcaagcagtacaaaactgagcactaggctattttctaactatctcgtgccttcaaatataatggtttcttttcagactgtcacttcctgtctctaacttagctgccgacttagttgtgactggttatttaatgtatgtcatttcatcgacgtctctgtttctaaaaattaactcctttacattggaaagatgaaggcttccggggactaaggatcagcagtatgtctcttttagttctttgtccatttctttttctgactcaaatgtgcccagttctgtatctaatcactgataagcagatcagcaattcttcagctggggtgtgtggccccgtcagtgcaaacctgagtgaccctctcctctctgtgcctgggttaggactcccagcatctctcaaggccaaactgccttgagaaagtgttttgcgcctaaggaaaggaagtgtcacatcagcccctatccacgagggagaaggtagcactgcttttcccataacatggttttaactcactcttgtgacccagcttgctgcacgccccacatatggatgggtccccctggactcctaaacgtcgccacctaaatttcaacatttccatttccatcattggcaatttactcttctgctccgtggtttcaggacttctacacatacccctacttatgaagattggggtggaggggaggaaaaataaaacaataaatgcttcttggatttcagaatggaaaaaaaaaaaaccccaagatttttagatttacccaagaatcccaaagcctttagtttaggagaatatttaatactcttattaatcatttttaatccgtttgcttttaattaagaaacagcatgatgctttcctatcaacatatgccagggagcagattaattgtggcttaagataactctccttgattggtgtaatgtattagctaacgagatgcctgcttccaacaatgctcagacactacactggaaagccagctaccctctagagaaaactcttctgccttcccctcctgcagccacagagtatgctaggtgtttaaacattttgaaaagttcccagacaggattagggcaacgcattccaagttttacagttgcttgaaaatatgggtcctataaaaagatctgctgtttacgcaaagtacaactggatgacaatgaccgccaaaccccagtggattacagcctagagtacatgaaggaaaggggtctcaagttctaatcaactgcatgtttagcaaaaataaacaaacttatgtaagcatagtgccactggtttttctcaacagacctgggagagttaccatactgttgtgggataatttgctccacctgggaaaagcaagctcccttccactgggttatggagtttacaggtttttttttcttcccccagacagggtctcctcctgttgcccaggctggagtacagtggcatgatcacagctcattgcagcccgaaactcctgggctcacgtgattctcctgcatcggcatcctgaatagctaggattacaggcatgccccaccatgcctggcaaaactttttttggtagaaacagggtctcgttatgttgcccaggctggtcttgaactcctgggctcaagcagttcccctgccttggcctcccaaagtgctgggattataggcgtgtgccactgtgcccagccagagcctacagtttcttgtttgctcccttagaacagttgtaagactcaattccagtcatccagaaggataggccaaccttattcccaggaagaagccattattatttccctccttaaaattatgaaaatgggcctggcacagtggctcacgcctgttatcccagcaatttgggaggctgaggcagggaattgctggagtccaggagtttcagaccagcctgggcaacatggcaaaaccccacctctacaaaaaaatcagccaggtggggtagtgtatgcctatagtcccagctacttgggaggctgaggtgggaggggaggatcacatgagcccaggaggttgaggctgaaagtgagtcatcatacctactccagcagcctgggcaatagagtgagacaaaaaaaaaaaaaaagaaaatgtggccagtcattcctagtattccagcgtggactttaaacaggtgtgatatgctaggctgctaacatcatgacaggcctgggcccgtatgccacctgtcagcatatccatctgtatcagaacattttatcaataaaatatcaataattctacatcacaacagtggcctgtcctaaaatgaatgttcaacagacactttctgtctgcatcagtggataagtatctcaggcactagtcagcctcactaattttatgtagtaattagtctatctcacaacatctaaatgacctgtttggaaagtttcatttctaacatactggatagctgttaagtcctccttagacaatggttcagcagggccaaggagtgaccagggcacaacctgatggatgtgagccctgattactataccctactaataactcaccttgggagctgctgggagacacctccagctagggaggctcctcccatttctgaccttctagacttctgggaaacacacagcctgatgggtgtagggatggcatacaaatcctaaggtacactcatattttggaaagacattttcaatacacctacacttacaaggctaagccctatccaacagaagcccaagaaaggatgtgatttttttttccaagggctttagagtacaatagccaaaggacatgtgggctagggtggccatcagacccctgtgaaccaagctcctgtgagccaatcccatctcagctccaggcccatagcagggccaagcaacactttccaggttctaccttacctcctccctgcctggccctgtgtgagaagtttggtgtatgagacttattcatcagtagcctgaggccaggttttgaggtcagtggaaataagtgaccctgtcaatagtgctttttcctatggtcctcacaggggcctctgttgagcattcatttcacttggaaatccagaataagagcgagtgggtagctgtgtgaacaataagaatgcaccatggcatcgggttgtgggaacatgagagcatgccaaaccaaagagcgtctgagcacccactgtgctcaggagtcagccccctttccgccgaggtcaatcagctgtacatttttgacttggtctatgttgctattatttttttaccttctaacatggagcaggggaaactagcatattttgaatgtctactgagccagacattgtgttccatactttttctttttggagacagggtctcactctgttgcccaggctggggtgcagtggcgccatcatagctcactataacctcaaattccttggcccaagcgatgctcctgcctcagccccctgaggagctaggactacatgtgtgtgccacgacaccgagcaaattttaaaattttttgtgaagacagggtcttgctttgttatccaggctggtctcaaactcctggcctcaagcgatcctcccacttcagcttcccaaagcactgggattacaggcgtgagccaccacatctgacttatgctccatactttactcatgttatttaaaactcactgaaccccatgacataaacaccacccccattttacagatgagggaatggaggcttaaataatatgcccatgccagtaaatgacaaagctgggatcccgaagtttatgagatttcaaaacccacattctcattgttccatgcagagtcctaatttcaatttctactattggggtctgggaaaaaataaatcagcctgtttgaaaaaccaggcttcaaattttggatctaagaatcaagtgagaaaccatgcccaggatacaaatgtgtgccatgttcttatgacccaatttaaactactgttcttgttattttcgttaaggagctgtagtgatgctttgcttctgcctgcagtgaaactatgaaccataaatcctactatttcctacagtaggatcgtcccagtggattcaaacagactcccataactcatggtaacagatatctctaagggaaacaaaagaattatagtgctcagttatataatatcaccgtgtcttcaattttctgtcccagaatttctgttttcaggattaagattaagaaaacaaattctctgggaacaaaaagaacacaaggcatagctaatagatgcctatctcgaaatgtcttttcttaccagtaaccaaccacaataaggattagagggtcacttcctggtgcaaagccagggtctagactcagccagtctttgcacttgagaaacacaacacacagtatctatcattctttgaagaaccacccccccccccccacaccaaacagcaagcagattgtacatcactccttctgaggcacacagatggcttttgaacactgcaaccctttcttctctcaagggcactgcagattttatcacccacctcacactaaactaggtcctgctgagcctgccgaatatggaaggaggtttcaaagccacatgccctgacatcataggattacccgtcctcacgttcagtccttggcattcctctcagagaactcaggagaatgctgccttttgtagatgggcacaagggaaatggcctcagtgctcagcatggctgcccccagtgcctaggcagcctcctactgagctacggggtggaggttctcttctgtgcttcaattccagccaggagcttgtacacacgtggtcaactgttctctccattgataagagacggcagtgacctatttcttcagacgctctgtccgcttgggagcaggatgctagggaaaagctgaagggcctatctacttgcttcatgcctggggggaaacttccttctcatccttgtgcctactgaggctggacacgtccattagtgactaatgtggtagggaggcagtgcaggcctctcctggccacacacatacacacacactccatttacctagccggccactcttaactggaggacaaactcttattttacacttgcgtgactttcaatgccaacttccactagaagctgccagtagccactgacaaaattgtctcactcaattatgatgccacagactgaccttaacctgaaccaaatgtcggagaaggctgtgctccccaactgcacatttgaaatatttatccaaagaagcttttcagtcataaaaaaaatgggcagacttaatacaaaggtgaatcctagaagcaccccaattcactggctttaaaactgacagcaaatctgggagctcctccttgagaacgattagcagaggcttcaggcaacactttctaggcagaggccagagtgcccctctttgtgggccaggacccttcaagccaccaccagccacccagccctccatcaatactctaacctggtagtcaccaaatgtttgtgatcacatagcaatgagaaagacagacaaatatattttgagcacatactaccaatattctgataaaatgcatttttgatgtaaatgattaatccatatattaattactaataaaggttaatttctttttgttagtaaaaataaacagaaataaaagttccagctttttcttcccatccatggagtgacttatgcagcccactattccaggagcaaatgctggtgcccttgctaggtcatcctggcttgagacccgccccatccccaacactgaggctagagcaccaaggacaccatctcagtggggttactgctctaggtcacgagccctctctgtgagatcaccccaagaaaatgccagcttcataggtccctttccctgcataagggtggatacttccttccatctctgattggaagtaggcagctctttagttgtagtcatggcatctcctgccgatcacaacctgttaggcttctgctcttagcccctccaattccctcctccacacagcccccttagtggtctttctaaaatagaaatcagagcatgtcactccactgcttaaaatacctgagtggtttccgacaggcctcaggacaaagtccaaactccttgacagcttacatggccctgtgtgatcatgcccctgccccttcttcctaccaggcacccagtctctgagctgccctgaaacagttgcaggatgttcctttgatgcatgttactcttactctcatggcttaggatgatgctgttccttctgcaggaacattcctcctaagccctgactgcccccaaatccagccttttcttctggttcatttctgctttgttttccagcctctcctgagacatcacttactgcacaaggcttcttagactctcctccatccttcccagagagggtcaggtatcttctcgctgtgctctgtgccctttgctgtgtttaacatgggcctcactattgtgcataacctctttatttgtctccccctctagatggtgagctctatgtggataggaacaacatttgcctctttcactgccatgcccccagaagcaaatgcagtgtctagtacccagtaagtgttcaaaaaggtctgctgaatgattgcataagctgcaacatatgccctaccacctcttctaacaagatgtcgtgacatgacatgttagggggagtagctgggggaggaaacagcttggatctctatgtttcccttctactcctgcccttagaggcctgtggactctttgctggcgagacttgcagccctcaggtggtgtgaggaactcagcaaaaaggcttctctttgagtgtcccacctaccttcactgttccttccacttccacaaaccagcgccttaacatggcttgaatctggccatcagtcagctcagggttggcattgtggattttcttcttgaccaggtcctccagcagaagacgcctcagccgccagtagaagaaggtacgggatgttttccaatccaggatatcctacatgcagagaagaataaacttagcccagtcctaattcctgcttaatgctcagtctggagggaaacccacaggcataaaaactgattctccaggcaagcccttcacagacccaagagctggctgtaaactcctagcacttccagatgtcccccagggcagaaatgcagcccacatgccctgctgtctgcagcactgtgcacagccatgggcctggctaatgctgatcccacacatggctgagatgttctggggaagaggctgtgagttcccagataaccagacaaggataaattcgttttgagaagatggatcaaacaacttgcagatcaattattaattagctgctgcgggagccttgaccctatagtaacccacatcctgaggacccgtcaccaatgaagtcacatgtgactcagtttcccaccagtaaaatgcagcttgcctcctgaggaattaatggaaacctaaattatacattgttttaagatgataacagttacagaaacagtgaaaatctaaaaaatattgaaaatgttttgatctgcagaagttgttttaatttggccctcatagctccctgcttatgagcctgtgtgcaacacacacacacacttgcccacatgtgggcctctgacaagaagtggcaaccattgtacttacgctaataacacccttctcctgcatccggcctggtgtgtcgtgcaagtcagcaaactgcacggctacctgatggtaaatgggaattaggaattcctcccgctccttcaacttgttctccaactccttccgctcagctgtgcttagctctggggtccctgcaattagataaacatgcccgtcacactctgtaatgaccaggaatctctctgcacaaaagcagccacaatcacgggaagctcaacatcagcctgccccctcttccctctgtggcctggctctccgttgtcttctctgctctttgctgattaacagggccctacaagatgccacaccagtctttaccttgccacaagaagcccacatgccctcttttccctgtggcagtcacaagtgtgaaggcagatggcagcccctctcccatgcctctccctgagaaggtgcaagtagcgacctagaggcctgctgcatattgctgacaccacccaggctcctccttcccctgaggccagtacttgtacactgacaccatgcccatccctgctgaccagcatcaaagcagctgggctattccacacgtgggatgtggtgagagcacccctaaactccgagcacaaactagtagctcctgtttccgtgtacatgcgagttatctgccaaacttggcaaggacctgaataactcctaaagttacaagccatagtacttcatggcttctaatctcaggtttatatactcttaacctctaattagtagaactcaatctaattagagctagatcctcacatcttgtgtcagctcagtgggttagcctgtgctctcccgcctgggctgctactgccagagccagtccctgaccagacaaagacattctacttcttaggctaaaggagaaggaggatgtaaaaagagaaaggcagttggcaaacctcatttggatcactgcgcacggtaccctgactcaacagacaggagactttggaaccccttataccaaggagggacccctcccccaatcaatagtgtcccagtagaggtgttgctatggtgtgcctttcttcctaattactctcagaatgggatctgcaatcaatactgaaaatttagctgcctgcctagtaaggaggagtaagcctagctgaaggagcaataggtgacagcccctggtgttagggacaccctgaagtgctttgtcaccaaagctgacaaataaatacatgagcacaggtgataggatgcagaagaggaaggtctatttcaagcatgcctgtctgggaacaggccttgttttttacaccacaatgaatcatatgccataaaaacagccttgggctgctgactgagccgtattatacataaacacaggttaacagaggagggatgtaactatagtacttaagtttcatttttattagttttttggatgcccaactctacctctttttttaagctcatcaccattttaaaactgtgatgaaggtgccactgatctgctgctttaggccccggcgcctcagtagtgttccttccaaaacacctgaacagcatgaacgcaccgggccccacactaagggatgacacaaaggcccattgcattctagtgtagatctgcctggagggctgatggcgggagggctgagggatggagggctgatgggaggagggctgatgggaggagggctgatagcaggagggctgatgggaggagggctgatggcgggagggctgatggcaggagggctgatggcgggagggctgatggcaggagggctgatggcgggagggctgatggcaggagggctgatggagggagggctgatgggaggagggctgatggagggagggctgatggcaagagggctgatgggaggagggctgagggatggagggctggctggtgtcttcggagatgagacattctcagaacacccttgttagggaagcaaatattttcccttctccacagaaagaaaccaagattccctggagaaatagctgattctagggatgaggtagggaaaacatcagatgaacctggggtatattgtgacaaaaaaacaaggaagccctcaaaaaacgattgagacatgttagaaaaatgcaggagccagttttgaatgtgttcccactgcccaattctgggacaatgaacactaaaataaataatgatatttattaacagacagaatatttgtggaatgaaactagaatctaccaattcaccctcatataagtaattaaatgagggagaagggaaagggaacactctctcttccagcagaagaacaataagtgtagcggaaatgatggaattagaaaaatcaccgttttacaagcatcactgtaaattactcttccaagaatcatcaatggatgtcaaagccagtgggtgaaagtttgataagaaacagaatattcacaaggtcttaaaatattccttacaaatcacttattaattacaaaggggaaaatggtaactttatcgtggattaacctagtgaacaacaccttaagcaagtaattaaattatcaccaagaggacagactgataccatgactcctgatgatgtactgagaaggacagaacatgacttccgcaacattcctgcccaaaaagcagaatcgaaatctaaccacaaacccaaactgaggaaacatgctacaaaaaaagtggctcactcttcaaaaatgtgaaaaacatgaaaaacaaaggtcaaagaatcagtccagattaaaagagaccaaaaatacttgacaatgaatttcaatgtatgctcattagatcagatctcagaccgcccctcaaaaaaaaaaaaaaaaactaaaaaggacattgagacaattggtaaaattttaatatgaatcatggattagacagtagtatcaatgtttacagttcttgattttgataaatgtattgtggttatgtaggagaaagtctgtgttcttagaaatacacactaatatttatgaataaagaagcattagggccaggcggggtggctcacacctgtaatcccagcactttgggaggctgaggtaggtgggttacttgaggccaggagtttgagaccagcctggccaacatggcaagaccttgtctctactaaaaatacaaaaattagccaggcatggtggcacatgcttgccatcccagctactcaggaggctgaggcgtgagaattgcttgaacccgggaactggagtttgcagtgagttaagatggcgccactgcactccagcctgagtgactgtctcagaaaaaaaaaaaaaaaaaaaggcaagaggtccacagattactttcaaatggctcaaagaaaatgcatatgtgtgtggagcaagagagaataaatacatgtacacatgtgaatatgcagaaataataaagcattgggatattaacaataggtgaatttgagaaaaaagcattgtattattcttgtaacttttttgtgaaattggaaagttttaaaaattaggcaagctggaaaagaaaacttattcctggctatccaatgcatacaatcaataatcaaagctaatatttatagggtactgggcaccattctaagtgctttatatctattaatttattatcacaacaaccttaggagtctggtattcttattattcccattttacaggtgaggagactgaggcactgagaatttatggacttaccaaggtcacaaagctagcaagtgacagagccaagactcaaatgcagcagtttgggtcccaaagcttttgaacactgttagctgtctcttctcgcttacttgggcagaagacacgtgcttcagtagtagtgtccctttaatttctgagaggctaagtgatgatggtgggctcctggctgataaaggttctatcttagtcccaattccataactaagaccaggacaatgtctccaatagttcccattcagatgcaatttcctaggcaggcctaagatttaagagttgtgtctcttgttactgtgagttcaagaactaatacaataataggtaaagtcacagccctgcagggagcaaagggatggcaagaccactgacatggctaaacgcacatatacatggaccatatctaacacaccatttattgagcatttaccactcactgcactcaaatctttcaggatcacatatcataatcaccaagcacaatacagatctacacacctacatctggtcagctgttaacactgctgccaagctgaatacttcaacgttactgcgtgctttcccagttgcttcaggtacatgatctccaatccttaggacaactcaactttatgccagggtgtctattttacaggtaagaaaaccacagctctgaaatgtaaagggacttccccaatggcatccagctctttttttttttttttttttttttgagacggagtcttgctctgtcgcccaggctggagtgcagtggcacgatctcggctcactgcaacctctgccccctgagttcaagcaattcttctgcctcagactcccaagtagctgggattacaggtgcccgtcaccaagcctgactgatttttgaatttttcatagagatttggttttaccatgttggccagactggtctcaaactgacctcaggtgatctgcctgcctcggcctccaaaagtgctgggattacaggtgtgagccaccgcacctggctgcatccagctcttaagtggcaaagtcaggatttacacttgggtctggctctctccaaagcctgtgttcttccacattaaatggtattgaaggctggcaagcagatatcctgcagtggccactatagggaaaccagctggagagttggtttgttgttcgcaaggagttaagagcaaggctcagcactggctgcagaagagggagcagctacgggctgaggacagtgtttcagaaaccaggctttggcttcgccaagttggaaggacggaggatgctggcttctgggctaacaaaggtcttgccctctcaatcaagctattctagagctttgaaagaataacaaaataaatgcctgtaatgctctggccctcctgagactaggaagattgcagggcattcctccaaagcctaccttgtttgattccttcagtaatgcctctgattatggttcaagacccacctcaaaaaagcatcaaaacaaggaaaagactgaagtggagaatatatgtgtttttaaatgcccatgtgaaggtcaaggatttgtgtgctttgttttaggggaaaaaagatttttaaaattttattttctaaaaataaaaggctgctattaagccagttatatcatgtgttgcacaccgagggcccctctctccttgtacagcaaagcagccagccccggtaatgatttaggggagattaacaaatatgtcaatgtctattttctgcttaatttaaaagtggcgtctataaagatttttgacttctgaaccctgttctcctgaaagaaagaaggtaagaatgaggagggggataaagagtgattatcctatcattgatcgtttgtcaggagcatttcttattcactggactattgtaaaaagctaagctctcgatcaatgctgtaagctccctgtacaattaaatatcttgaaatggttttctttcttttctagccagattgcagggcctcagggattttaggaaagcaagttggtgtgtacacgtgtgtgagtgtgtttaagaatatgctacagagagaaaagtcattcttttctagaattctacattaggaaatggctgagtgggagtaaaaaggtaggtgctcccatcctttcctatccaaaataaaaagtccctatgcaagttgggaggactgcctgaagccaggatttcaagatcagcctggacaacaaagcaagaccctgtctctacaaacacacaaacacacacacacacacacacacacacacaaaatgccaagtgtggtagctcacacctgtaatctcagaactttgggaagccaaggtgggaggatggcttgagcccaggggttcaataccagcctgggcaacagagcgagaccctgtctttcctcctgcatgccccccaaaattagccaggcatggtgaagcgtgcctgtagtcccagagatactctggtggctgaggcaggaggatcgctggagcccaggagttcaagctgcggtgaactatgattgtgctgctgcactccagcctaggtcaggagtgtccaatcttttggcttccttgggccacattggaagaagaagaattatcttgggccacacataaaatacactaacgatagccaatgagctggaaaagaaattgtaaaaaaaatctcgtaatgttttaagaaagtttacaaatttgtgttgggccacatgtggcctgcaggccacggttggacaagtttggcttaggtgaaagagggtgaccttgtctcttaaaaaataagtccccatgaaatcctaaaaatgcacacttttaattaaaaaatttaaagagttaaacagagacgaaatatcactggtcaaataagaagagctaacactattgagatgttactgtgtgctggtactgttaaagtactttttatctcatttaatccttacaacaatcctaaaagatgaggaaactgaggcacaaaaaagtaactcacccaaggccacaaagctaggcaacagtggagttgtgattttggactaggtaatctggtttaagagcccatgctccttaaacaaagcagttcaaattgacttgaaagtatccgcagcacagtggcctatcaggtgttccctggagccaggatacaaagaaaagccacatttctcctccatggtatcaaaggtgaagagaggctggacacggtgggtcatgcctgtaatatcagcactttgagaggccaaggtgggaaggactgcggaggccaggagtttgagaccagcccaggcaacacagggaaattctgtctctacaaatattttaaaattagcggaatgtggtggcgcatgccttgtagtcctagctacttgggactgaggtgggagaattgcttgagcctgacaggtcgaggtgtggtgagctgtgatcatgacactgcactccaggctggcagacagagtgagaatctgtctctgaccgaaaaaaaaaaaaaaaaaaaaaagctaaagagaaactcccagaggaaacggctgatttctgcagcaggaggcaattttttgcccagccatatcacttaaataggccaggagaaggtcagccctagtctgtgtatgaacaaactacatcctaaaagtaggatttgggggaggtgacatcttcaaagcttggaataaaaatcagactggtagactaaaaattctctgctcagccaaaggctctaggcgaccttgtagaaatctttttccttttctgagttgagttcctcatttatgtaacaacaatcccagtctggcaaacagggaaaatgttttataaaagaatgtgatattaaagtgtttttaaaaacattctcaacttttaaaaaagttatacttggtggcaggcacctgtaatctcagctacttgggaggctgaggcaggagaatcgcttgaactcgggaggcagaggttgcagtgagccaaaatcacgccactgcactccagcccaggcgacagtgcgaggctccatctcaaaaacaaaaacaaaaccaaaacagttatactaagaagcctatgtaaatttaaatccaattttaactttgatgggcccttcttcctttacttaagaaagcaatttgcgccaggcacggtggctcatgcctgtaatcccaacactttaggaggccgaggcgggcggatcacctgaggtcgggagttcaagaccatcctggccaacataaagaaaccccatctctgctaaaaatacaaaattagtcgggcatggtggtgcatgcctataatcctagctactcaggaggctgaggtaggagaactgcttgaacccgggaggcagaggttgcagtgagccgtgatcgtgccattgcactccagcctgggcaacaagagcgaaactctgtctcaaaaaaaaaaaaaaaagaaagaaagaaagaaagcaatttgctttgaatggttcaatacttatgatgctagagataagaacaagaccaccctccccagaaagctcctgaatatctcagatgttaaaacatactcccatccctcaaccttgagactgaaaaatcagcataaaaaagactggaatcttattaagattcagaagtacaaacacaagcagttgtttaaaagatctatgtaatcacattttctatgttgaaagaaatttttctataaacatagtaagataggtaaaaaaaaaaaatcctgcaaaactatttctatatccataacaggtgtgcctttctttacacaaaagcattcttgaaaaactgcgtaaatcagatcctgttttaaatgccttaagggagctattttatgaggaaccctgcagtgaatcctttggtaaggcaaataatccttttgtaatgggaataatttctcccaatgtatctagctttttttaaaaccccattttcatatatctgcttttcttcaaagggggccatacctatctaaatacactcacatttgcatattgattttaacagcaatcctctcaggggatgtttaaccctaaagttccctgcaacagtgttagtgctctactgttcatatttttaaaaatcattatattaatagaaaacccagagatttccaaacaggaataaaaaaaaatactgctcccccatcagtcccgtccctgtgtttccacgcagacatatccatataaaaaaggtcagggaacagcacagaattctctgaattcttctggtagaaatatgcctctgtagtcttcattattttccttccctaatttgctctccctatgtctggcaggtcaggatacggggatctggtcatttgggaccaagacacattctgatgacagctttctcttgggttccctctaactaaatgcctgccaggtccctctggccatacagaattgtgaaacactgcttccttgggggaggcaagcccaggtgcttttataaatacaatcagattaaaggatcaaactaaaatgacccctttctcttctcagaaaattttgtcactattgcactaaacttcaccgagccaaatagcttctgaatcagtgtgaggggtaggttttcagctactgctaacaaaagagaggaggcaagatcccatatctaccttcgtgatagaaagcctcgtgttatttctcatcagcctccttaccgcaaaggacacagtggccatagtgtcagtgaggacactccaagttcaacaggtgagaggtgaaagaccactcactaaggcatgcgtatcggaacttctttctttcctagtcttaactttccaggcaaagacatactttctgcctcaaacaagcaactctggctcttttcagctttcagcctctcgaagatggacataagagttggaaaaacacagctcagatactttgatcacctctgccagaaaagcagcttaacccttaagtccccttagcccagggaacagtccttttcctgtcattctggctgctagagaaggcttgggaggaaggcattcctgaagatttttacagagaagcgtatcctcacctgccaccacaatgctccatatctgcacctggggcaaccttgaccctgaaggcatggtgggtgtgggcaggcctagaaggaccaggcaagggccagcagcagtgctcactcagtccatgctgctgctccctgtggcaggcagtcagggcatgttctgtgtgggcgcagtgcggtgctgcatggcaggctgcccagctgcctgggaacagggccacaactaagaacaagttcccctaagcggctcctttgcccaggtgctcttcattttgagagagagggacagtggggaacttacaattgcttcacacttgggctggacagttctctctccatctaaattgatttgtcatttctctctgaacacaagaggaggggaaggatccaggagaggacctcaggtcacagcactcaagaggccaggctagcaaggccgtcccgctccacagccactctccctgctcctggccttgtgaggcagtagaaggatgtcagagagagacaaaaaggacttggagggctgcggctccatttccagagaagaaatttaatttccttaaggcaaccaaatggtaggaagtaattctcctccttgcaatgactctaccaagccctggttctgtgaatcagggtcagaactgattcagcaatgcaagactctggggcctgggctttgctcacttttctttctgaggtaattcttccctttacttctattaggaatcagtgtaggcactatttacatattttctgttataatcacagacctgcaaactagtaattcaccatctttccacccaaactaaccatgtaagatgacaaaaggccatttaaaaaaataaaaattctagaagagatgaagttagctgctcagaagtcaaatattactcattcttataaaatacatagcaattatgattttttttttttttaaagacagggatttgctcttcttgcccaggctggagtgcaatggcgcgatctcggctcactgcaacctccacctcccaggttcaagcgattctcctgcctcagcctcctgagtagctgggactacaggcatgcaccaccatgcccggctaattttgtatttttagtagagacggggtttctccatgttggtcaggctggtcttgaactcccaacctcaggtgatctgcctgcctcctcctcctaaagtgctgggattacaggcgtgagccaccgtgcccggagtaattatgtttttgaacacagtcaatcagttgtgcgctggtttgtctaagtgatctgtgagcacgctccccagtaaagaggcagatttggggagagaacggcaacacaagataacatccactcctacaggctttctcctaaatcagattttctctgtggaaatggctttagattacaaaaggaaagaatccttgtttaatttagttcgggctcagtattcagttgaggaaaaatctgaagaaatcctgagaaaaggagaacacagagaatgagaattccattctggactctgatgtacatttatttattttgtatcttagatgattcacttttttggcctcaatttcccagtctgaaaaatgagaccattttcacccactttgtgaaaaagaattttggtagtttggttctaggcaaactaaaagagccagaatcattgtgaaccccaaaggaactgggttcataatatgtcctgttatatctaggctgacctgctttgtcgcagagacagctgcccgtataggatatccctgagagacaggactatacttctgtttctttcatattttcacatgtgggactgagccacagagaatactggataccaaacatggccatctgctttttctaatgattaagacagaaagataatgatgcaatgaagtaaatgcatgctcatctgctcctcatattagctaggcagaggtgtgatctccactttatggttggaaaaaaactgatgttcggagaagttaaataatttacaagactcgtagttcgttattcttattccaagtccactgctcatgttcccaagctgccctaggccagagcctgcttcacatttagcagactaagggtcctttttcaagtgccattttggtcaaggttaaataaatatggttttctccaatgcggataggaaattgataatgagatgatttgtaacaaatgattaaacggctatcacttgggagtctcctccctctccccttcatgtgcttcaaaagttaaaaggtgctggttgaaggtgggagcgacatcactttccttgaagagaaagaagctttatctccacacccctcaccatccagtccttctgcaaaaggagaaaggatccctctccctaccacccagttactctgaagggatgataacagccattggggggttaaaaagaggcagtgaacccccagttaatgagtaggaattcagcaggcagtgtaagataaatggagctctctctgcttctgctagagtcagcatgaactgcggccctgcggcttgtttgtggcaaatggagtgcgcgaaatatcaaagggcagtgatccagaagaagaccgactttgacaaattttaaattggccagaaagaaaaccagcaaaaagaaaaaaaaaagggaaaagaaaaaggaagaaaaaaaggaaaaaggaaaatgatgcaatttgctgtgtcctgcaattgcggcattgctgcctttgtatggaattagtggtaaacacagcggcaacaattgggggatgctgggagcaattatgagccatctaagtgagatgcttatcagtggctgaagcttttagagctctctctatgaacagttgtaagtaacttgctcttgagctgcagttactttaattaaagtgtacagggttggtcagaagtaattattctgtttggaaaagaaagagaaaaaacccacctcaattctgggtggcaatagattttagaaacaactctcatttcttgtatgtgtgcattccccataaaaggatcagactgtggtgagttagagttattggtggctgttacccagtggcaaacaatgggacacaaacagggtttcttgtaacccaagtcaccgtgtttggcaggcaacctggctcagggctccaaatgcctggatgtacagtctccacagtgtaggcaaacgggatttttctgtctctggatggtggggatatacagtccacaaatggtactttattaattaaattaccacttggaacataaatgagctagcatctctcttctccattcactgagtttcactaccttttaaaggcaatctctgttcctttagaaaaaaacaaaaacaagacaaaccaactgacaaaagaacctcgagcaattatctttactaacatagcaaggggctcaatgggagacctgggcagaaaatcagtgttttaaaagaatctgaaactcatttagactctggactcaacacaggactcccatggtttagtcctatgttcaaattgccaagtggcttccaaaagctctgaaaacaaatgagcaacagagcaatggctggaagcattaagcacgcctgctctcagggctattctggctgcagctactgtttggaagcacacagtgcgcaatctttacttctatttctctagctcaggaagaccccggaacaccacctgggtaaagactcctgcttttctatcccatctctcagaaatgaagtgagctgtccaaagaaacaagcagaaacaggacatatttaaatctagcatattctctggtgaggcctgcccccagcagcaactctagctaatcattctctacaaggacatcttagaaagacgggctttttgtactctaaggaaatatcaggaaaaaaaatcaggtgacttttgcttttttagggctcactttccctattatacacactatttcattctaccagggttcttaccatatagaggacagtaaataaagattatcatgaatttgatcaaatgcttcagtgcctcctcccctggcctatgaatgcactcattacaaatcagctgaatggctcattgatttgccagaaggacaagcagacatacccaatcgctcagccaagtggatgtagactgggtccacccgacgcatggttttcaccagatcctttctgcggaatttgatttctactgtcccttctggctccagaacagatcccctggatcagaaagaaagaaaaaacaaaacagaaatagaggcactttaaaggaaggagacaacagaatgaggccagttacaatttgtagaccaggaaatagcttcattatcattttgcccacctatggttaacagacatctccccggggagaacagtaggcaccagagaagtgtctaagtgaggtatgagaaaggcctggcaaaaagcaattaaaataattctcattaccacaccagtcgacttccatttcaaagggagaagaatacagattccaccacctacagctgataagagtaacaggaatcacattattttccaggggaaaaaaatgctgtaggcacagtgacaggggaaccacctccatcacgtaggatgtacaataatgaagggcaatacttcatcaatactatctatctatctatctatctatctatctatctacctcacctataccacagctgtcagtctgcttgtaggacactgatcagacacactaagccaggccaagtaggaggtaaaacattctgcccagcgctatggaaatgagcagagtcaaaggtctcagggttacttttagtgcatactaatgatgttcagtccccagaaactttaccccaaacatgtttaaaaaaaaacccacagctttctagtttaaaaaaattatagataatgtttactatgtacatggcactgttctaataacttacatataaatccttacaacaatcctatgcccagtctccatctactatgtagtaaggttctgtgattattcccattttacaggtgaggaaactacagtttagtaagttatgagactcgtccaaatataacaagaggcagaactggatttgaaaccagacagtctgattccaaagtctatagaggaattgtctctgatctgatatcagatgagtttaggacttaaaaaataataaacccctaagtacagaatgtaaataataagcctctcagcctagaggtttgacagtgaaactactggactctcctaagcagcctttgacatagaaggctgaatctggggggacaagagagaagcgggcggtccactaaaacgactggaggtaagaatttccttggaaaatgtcaaagaaacacgttttgaagtttacttaggaaagaggtgagaacagactatgaaaggatgccagattagatctgttttatttaggtagtttcaggtaccacctcccaataagcctgaggttctcccttacagtttttttgggtgctacaaacaccatggtcttcagcttcctgaaatgctagagtgaggacctggactgtaatggaaggaaaaagctttggtttggaatcacaggatgtgggtgctgtagtgccatggctgtaacattctccaggaggaaaccaacagctacagggtccctaaaggcagtgaatggaaatgtggaaggcacgctacctgctttctcggtcagcatacatctccatgtgccgggggttgatggaggagtcaatcaccacccaggagccaccccgcagctcagcctggggaggaatgtaaaccagcacaggctggcagcactccctcaagccatccacaatgtaagcaccaaacttcagcacttggtcgtacatatctatggagaatgagacaaattagaaatcaagaaatttctcttcctcaaagcagtacttttaaacactgttcaggacctctggccacgaagagcctccttatactatgcctcctgtttggccaccctatagactaaagggagtatcgacctgtatcccattcaagactccagaggatcttcaaaagcacaagacagcaacagagagatgcactgtctttcacaagatacagtgtgtaagtcttccagattgcctttccattttatatcctctctgaatttctgtactcacgtttcaccacattaattcacatttgctctacaaacgttgagtatttttcatgtcaatatgtgctctcccactacagtaagtttactaaaggaaggaactattctacctcttttcagttattctcatgatgcttagcataggatgagctcttcaaatgtgcacctaatggaaattgatcctttaaaaattttatcttcaaaaactatttttcatcttggtatcccgatatccctgcccagtgcctgaacatagttagtgctcaacaaatatctgctgaatgaatgaatgctgaataaattagttatatactctggaaagaatataatgagaaagaaagacaaattctttaacagttgcatttttatagggtatcaatgagagaaaaattttaaaaatacttaggaaataccacacagccacatgagaagaacagacccaaccagggcagcatagtgagaacctgtctctacaaataataaaaaattagctgggcatggtggtgcatgcctgcagtcccagtcacttggctgaggtgggaggatcacttgagcccaagaggtcgaggctgcagtgagccatgatcttgccactgcactctagcctgggtgacagaacaagaccctgtctcaaaaacaacataaaacaaaataaacaaaaaacaagagaggaaccacctcttcattctgctaaagactacactttgtagactgggaatggtagctcacacctataatcacagctccttgggaggctgaggtgggaggaccgcttgagcccaggagttcaagaccaacagagagagaccctatctctacaaaaaccaaaaaaattagcaaaacatggtggcacattcccatagtcccagcaacccaggagggtgaggtgggaggatctgagcctaggaggctgagacctgcagtgagctgtgatcatgctgctgtactccagtgtgggtaacacagcaaggccctgcctttaaaaaaaaaaaaaaaaaaaaaagagtacattttgtaatccctccaaagccaggagcagcctgaagaaaaggacccatgatgtacacataaagtgagtccctggaaaactggatcagttatttatttcccaactttttatggacttcccatttcccagctcactgaagtccattgctaaagctttaggtttatgagtccagatgtttaatgagtacttcagtggagccacaatggatcctttctaaataccaaataacaggttcaactgagatcaaactttcttatcaaagagaggatctcaatttggaataaatcaattctgggaatccaaggcaaagaagcatttttcaggaagttaagagcaaaccaaatagaaattgctttcattgtagttactggcaaattaaactgccaccttctccaaagtaaaaatggcttaatatacaaactatcagtgagcacagttcactgcaaggcacatgctccactgccccaacctggtgtgtctgtgaagacttcagaaattccaagttaccccagaaaacaccccctactctatgtggaatgtgtatgatatgtactccatgtatatgatcagagtgaagacatttattcctttgggagaaaagctaagaccaaaaaaatttactgctaattaacaactgctgtatgaagagcagggaataaaggactttaagtgctttacgctaattctgtagttatgaaaataattgctcagttcaaattattttaactaaattaattctttagtggatatttcaaccagtgctacataataaaataattgtgtaattagcagtacatttttcagtgctgccaagagtacagtctccgaacaagtaacagaaaagtgtccctcaatgatatcatacaaagagaggaaatgaaaggtatagataaaaggagaaaataaagcaataaaagacagcacaaaaagtcattctacctgaaaaagaaaaaaaaagttagaggtaagtgaagacaaagtttccagctcttttactcacttcttcttgttaaagacttagctacaacaaaatctatctctgtattataattaacagattgacatctcaaaaagaaggggagattttatttaaaatgtattttcattcatctattaaaaaaatactagatttcatagtatatgcaaacagtttcaaatgaagatgagtgtgtgtgtgtgatttttaattttatgaaatggacgtgggctcctttttgtcatcatcatggctagcttattgtgtaccagggaacatgattatatatacacacatataaatcatttaatcatcagaacattatcttatttatatatccaagttgcaggtgagtaaactgaggcttaaataagagtgagtggtggagataagactcaaatctagatcttgttggccctaatgtccacattctactacttcattcttttttttttttgaggtggggagcggggcgcgccaggttctcactctgtctcccaagctggagtgcagtggcacgacctcagctgactgcaacctctgcctcctgggttcagacgatcctcctccatcaacaccccaagtaactgagactacaggtgcgtgccaccatgcgcagctaatttttgtattttttgtagagacggggtttcaccacgttgcccagactggtctcgctgagctcaagccatccgcccacctcggccttccaaaatgttgggattacaggtgtaagcctctgtgcccagcctctactacttcattcttactgctaggagagacagcatgagactggggtactctgctttccaacatctaatatgatgagtaaaataaaaccagaaaaagagacttgaatacatgactgaatattcccaactgctgctggatttcctctgtgttcagaaatgttcaaaactatactgataacactaccagcctgtgtgaggcttggatctgactgccaaacaagtatttttcggccccaagactgtgagtaggaaaggagcatcagggtttgttaaagctgacatgtttgggactaatatattgcctccatctaacttggaacacctatagacccacagcccaaccatcaaaacacccaaaaagcaggctattaaaatataaacaaacacacaaataaactctgtaatcgacatgctcagactgaactgcagctgccccaaaccacttattttgaaaggcaggttgaaacacttggcaacaatctgacacacaattgtctgaaatcccttcgtatttaagagacagagcaaaagcacagccaatagcagcaggggaggggcgatccccaagggtttaggttagaaatcagtctacagaattttaaagctatgcacgtgctgtcaattctcaggccctgagaaacgcaactgggaatggaaaatactgataggttcctcactggagaggcgggagcttggagttttctagcatgctgggcaaagcacatctgcatgaatggtgaccacacacaacctttgcagtgtgctctcagcacctaggcaccaaccctgcctagggcttttattgttataaacatggataaaccgtggcagccatgtgtatcaaacaagggaacagggtggcagagtgtttccacagtgtcccacactcttgaaaatgaaacagatcttattggcttgggcaagattatctgttagaaactgaaggtaaacattagccatacacaagctacatatacataatgtctctccttagttcattatgatcggctgacactgtatttcaacatcctagtaatcagagactttaaaatagactttcattccagttaaagttttcaataaattttttttattgttatttataacctgtcccaggaaaaaataataagtataacatgaaaagccaactgagagtgaccctgtagcaccagcagtgaggcagcttaatatcactgggatttgcatcctatcaagctattcatgctgaggctgggaccctggtgctaatttctagtaaatttcacgcttgatgtctccctgttgtgggtcattgccggttcgtctaaataaactgcttccaaatggctcttccatctaaatattcagccagtttttataatttaattttgcattatgctgaatagccttccggccagatagagctcattgaaaaaaagcaccaataccatcttgacatgcttttatttatttatttatatctttactgctcgaattagacctcctaggccgactagtagagttttttttttttcccttcactaatgtcaattttcagcatagcaagagctgtctctaatcttttcctactcattacacacaattttggagtcattttacccacagtgcagtcggctcctggctgtgtgtttgtgtgcactgagggatggcataattgtttattttccctccctgcataatccccagccagtattgaaaccaaaactgcaaacatctccccaagggatgtgaagaatgacaagaggccctcagtttaggtccctttacatgagataatacaacaccctgacctgtatgtaaatatgaaaggcactgttcctccccctcctaccttcacagggatctctatcttccctaagtcttatttgtcttacgtgaggtgtaaaaggatgcatcagcaccaaaattaagacagaacttgccctggtctatatatcaggccaaaaactcatttcagaccaagggcagcagggagaaaggaatgggtacttattgtttaaggggtatagagtttatgttgaggatgatgaagttttgggtgtagataccagtgatagttacacaacactgtgaatgtatttagtgccactgaattgtacacttacaaataattaaagtgataaatattatgtatattttaccacaataaaaaatgaactcatttctgagctcttgaaatttcttttcacaataaccaaggacatccccaaagtagaggggaagtaggtggataataactttttcaggaaccttgacattctgttatagggatattctagtagatctagttctggttttaggctctaactgtgttacagggagctacatcacatcagccaactgtgttacaggaagtcagacagatccaccttcctttcccaactctgccattttgtagctgaatgagcttgggaaatttacttaacctaatttacataaatcttaatttatgtaaaatgttcataacaatataacctaccccttagaggtgcttgttgtgatgattatgtaagataatacatgtaaaattgttagcacaagtttctggtgaaaagagctcaatgaatcttaattgttgttgttcttactgttacagcgcggcagccaatctgggcctgagccaaaatatgtagcagaattgaagcttttcctagaagtggcacattggaaacttttgaactctgaactcccgttaggataaaatatccagggtgacactctgaagtaatgtcaggaagagtacattctcagtgggccccccacaaagagataagtaaggagtaatagcatagcattctctcccaggtctcaacaaaaatattagagccaaggaatttgggatcaagtgaaatctaatgctgaatgaacctcatatatatgaatgaggggttttcaggccccccttccctttgatatactactaccatcttcttttgaatatcctggtattttgtttatacattatggctttatcattttgctcaagacatttttcttgtctctgtgaagcaatgtattgtttctgacttattttgacttatttttgttctctgaagtggctagcatagttcctaacacacagaactcaataaaaatgtgtaggattgacttaaccgtatactctcaatttctcatggtatttccactaatttattatctcggtcaaaaaataattcaccttgataatctaaaaaatatatacaatcattaatttggatatatagtccaagtctcccccaagaaaagtataaaatgtggtagttctccagcaaatacaggcaaaggtaaacttttcaaccaaacacacacacacacacacacacacacacacacacacacacaatcaacctagtcaacattttgccaaggaggcctggccatacagggctcttcctagacgagtaaggaaaaattgtcggcaaaaatttcaaatccctcttgccacataactgaccatctggtagtttccccaggcatttcctccctcataggctgggggtgcttctgccctaagctatttttaagtgccctattgagagttcattgtttcacattttgtatgtcttaagtattttcttttctttttctttctttctttttttttttttttgagatggagtcttgctctgtcgcccaggctggagtgcagtggtgcaatctcggctcactgcaacctctgcctcctgggttcaagtgattctcctgcctcagcctcccaagtagctagggattataggcatgcaccaccccatctggctaattttgtattttttgtagagacagggtttcactatgttggacaggctggtctcaaactcctgacctcaggtgatccacccacctcggcctcccaaagtgctgggattacaggcgtgagccaccgcgcctggccatcctaagcattttctaatcactatttactccaaaagtttctactcctccctccttcccctaacctatcctactgttttttccttttttttgagacagagtcttacccttttgcccaggctaaagtgcagtggcacaatcttggctcactgcaatctctgcctcccaggttcaagtgattctcctgcctcagcctcccgggtagctgggactacaagcgcccaccaccacgccagctaagttttgtattttagcagagacaaggtttcaccatgttgaccaggatggtctcaaactcctggacctcaagtgatccacctgcctcagcctcccaaagtgctgggattacaggcgtgagccaccccgcctggccctatcctattgctttagaaccccaaattctccccaagacagatggaatttatacttagcatactctcataccctccaggtatgcagtctctggcttagcatggccatgaattatctggccatgggacagagggcttcactactgtaagaggtagtgtttcctttggctctccctgtagtgtccacagtcgctctacacatcaaggtttctccgtaaatggtgatactggctgcctaattacttagcaattcccatagcatggagtagagcctttgtaataatggtctaatatgctggagccacaggcccagggctgttgttagataataatataacatagcacaaattgccactggtactgaacagcctctggtactgaatttgttcattttcttccagtaaatgctaatttcagtatctgtcttggtcactgtagaacattaggagtaacaccaacaaagtatatgcccagaaaagagggacagagtcacaatcatatttccccagcaccatcagaatggtccagcatccatctgtgagagcgagatccacaacagtaggtcacctcaataacactagtagtagattattctgaaattctgtatggaattataaaatgtacttttttccattcaagttgcaactcaaaagatgtctcagagagggcagaatccccaaaaagcctaggctattaggacacccacagattctgctgaatctataccctccctctgccgcagagtgcccagtaatcagtgatgcccctccagcccacaggcagcccagtcacctttcattccaccagagaagcctctccagttggcaaagaccatcagaggcagcccttcccggttgaagtccttgatggcctgatatgtcttaaacgcagaatctgggaaccaaacctggccagcctgctggattatctattaggaaaagtcaaagaagacacaattaacaacacagctccagggggaaatctctccaaggtgaacaagattttacttatttaaaactgaaaactaaaaatcagatcaacaaaaactattgttcatcaagatcatcatgtttggagtaaaaaagaagaaaggatcctcgatctttgaccttgtcaaatactattctttttaagtcctgattataataactctgtagtcaaaagggaagaatgcagtcctaagaacccttgttctaggtttctcaaaagctacttaaaatggctccattgtgctactctttaaagcaagtcaattgtacatagtctcccagtcctttcacctttgtgcttagtatagcattttcctgtactgtggctaacaaatagacaattgacgtcacactgctgaatagcctcctccctggcctccctgacccctcactttctgaatggtgtcaggatgtgaaaatataatccatcctttaaaaaaataatggcaccaggcacagtggctcatcccaacactttgggaggctgaggcgggaggatcccttgagcccaggaggtcaaggctgcagtgagtcaaaatcacaccactgcactccagcctgggccatgaaccatgtctcaaaaaaaagggctgtggtgttcacgcttggcattagggcagacttcaccgttaactctagctgtagctcttccatgtgtatactcagagaataggggaccaaagagccttcagtattatctcagctacctttctgtaagaccatctccccaacaaaagtatacgttttctagcatcaagaagactactgtaaagacttatttaatttttgaggcagaatttagcttctagtccgtttagactcaccttaaaagtgagcacatgatgttctaaaatcattcaaggctgctgatgcccttccctctaaaactgatggtttgcaatgttcctgatgtattcacaggcactgcgaagagaaaaaccctccaagcacagcccccagtgtacttgaggtggcctaccttggcttcagaatccaggtttgctggatcagctgggatacttagttctactgttcgggtttctacagcaacaactcccacaggtattcctcctagcctgataaaacatgagtcacataagaacccaatgtatgtcaacattatagctagccatttgttttccaatcccaaatcaagacattggggaaaaaactagaaacaaacacagagagcaggggaaatctgattcttctatgagttaaatgtgagactctacggatttgatatttactctctaaatatggtgggaaaccaccctcagaatcacttctattcggaaatgtcccaacacaagataaattcaaaccaagggctgttctaggggagcctctacatttagactcaacagcctagcacatatacacatccctacccctgtggctgctaaacgaaatttctcagttcactctagagcatctccttggtgaagatggtaggaaatggtctgaaaggcagtaggaatctgagactttcagtaacttttaatgaggactgaccttgctgaaatggagctgtagttttctatggaatattaataatgtggttccagataagatttgagggtacaataggtcttactattaggtgtgtggatagggagtatgtaggcatgttatgaggatgatgagaaacacatgccaagaatagggaagtggatcaacaagcccttaattttctccttccttggaaaagacaaatgggacaaggataatttttagtagtaatgctggtgaagtctatattagaattatatatttaatctcaaagctatgtttatttaaaaaactgtttaggagctcaaagcctctgcaccttatactccactatgacttcccaatttggtcctcataaagattttctaggaaaaatcagagagcaagacaaagtacagggtgagtctttactctggaaaatgtgatgcagtcttcattctcactgttgcattccttggggttggggctgggatgggttatagtctctcatttctcacagcatctccataacaaacttttccatgacagatggcctttggttgttaaattggctagtgaaaatggattcctgtcatcacaagagggctgacaagggcctgagtggagaccacccacccccttgtcacttgcctgcactgaatcagaatcaaaagccctctagacaaccagacaacgagcaggagatacacaggagggtttagaaatatttctgttcacaatgattaacaatccaactggaaacttgtaattgcaaaagccaccctaaatcggtaacttataacttatatattagggcccatgtgacctaataaagaacatctttatccaagtattacagttatttattgaacttgaaaacagctcagaacaacttctgttttctattatacttcatataaattttatcaggctagcacatgaagatgctacatcttgttttatagtgtgtccctggacaaggtgccatggaataataaaagacaatttacagccaatagcacacatattccaaacatacataccaaagatgagttttggcagcacttacagtaacaatcccagacgaatacatttatatttatttcttgaaatgccattgcttttgaaagaagctagagctccatttgtgttttatatacttgtgagtatgtgtatacgtttggagtaagaagcccagaactcgtcagatagaaagaaaggaggaagtcagagtgagtgttgcaataaacaatgacagagctaaccaaagccaagcttgactgatcttggtcgcaaagcaatccctattcttctaatcataagtgtaaagtatttttctcttatttcccatgggaggatcttaaagaacttaacaaaggtttggctttctgagacttaaaatctgtcatgttttttcacagacaggaaaattgaagcagaatagatgagacaaatctcaaaaaagttggtcttagtgtgccgtgaggaatctaacaagctgatacaggagtcgagtatcagggttctcgctccagtgtatctcctacttccaagctccccactgggaattttaccaggcacagagaatacttctcactgggactgagaagcctggggtgagataaaagacctgagactttaaagaaaacagacaggtaggctctgggacattcagtctgagctgactccaggccagaatcctattcagagtcacagaggaagaccctgtctgtgggatttgccctctgatggcttcttgtcacaggcagcatggaggcgtgctgacctgctgtactgagagaaccacagagcctagaattattttcaaggctagaatctaaatctcaacccaatgtggcatgtttgagaatcttgagcaggtgccacttttcaccaagataaggaaaactgattgcccccagaggaaggtgagctccagatgcggtccctcagcagcatgtctctgcagtgcagaagtagattaagatcagtcgtggcaggtgctcgttatagctcgttatagcaagcactacagattattttgcacagagcttgctgttgagtgaagcacttcttagagtaggtattaaaatttaatagaaacttcaatttcccacttcaaaaatataggtatcttggcaacctatttcagcttattttactcctgtttcaggtaaacttttttttttggcaattcacatctgattataatccaatatagtacatttgtcacttaaataatctcggtgccacgaagaacctctttccagttacatagaaaagcagatgagtctctgaatcacttgtcacctattcctgaaagaaaattgtctttgggagagggaaagtcattggtgggctctggctattgtagttgggctttacagctcccaaagtgtttttcctgaaacattataaaaaggaagtgttgtcaaaattagccttcagattaaacgcatcattggagtgacacacaaaatggcaactgagaaccagcactccaattattttgccttgggcatggctataatccaatattctcagacagttcagacaaagagaacattattggtatatatctatagagccatggctctttctttcttatttttagttgggaggaaaaagagctgccaaaacaaaagagctcttacctggctctaccaaccaccacagtctgtgcccagggctgcataatctctgagaaagatccatagtcaaaaaagccactcaaccactgacctttttgggctacagaagggaaagaaagaaaacagagaataaggacagtgaatccattgacaatgtgctggaactgacgaatttaaggtggtttgggggattattttggggagtttgttgtttttaaccaaattataatagatggaagcattaggcagctgaatgttcatctgccttcagacatcatctcctatttcatttgctagtctgcataaaaagaatcatttatcagcaaaagcatcatttattgttaaatgacaaggtttagctagcagagagagtttgcatgcttttaaataaataacttgactttcttcaagacactacaaacatttgtcaaaaggctgccaagtcattaaagatattttcaaaatgtctatttctattttaaaacttgccttacaattttgtttgattccactgactttcttttaactgaaggctaaaaacaaccaaacaataagtattaatgatcagataaggatccaaatttggagggaaaaataggaactcagtttctccgctacaaaagcaacaagatatatctactttattaaacagctgataaagtataacctttctacaaaaaagggccacatattcttgacagatagtaaaaatacaatggttaagatgcacatacttaatgccattaatcttccttgcacatagaatttccttcactggcaagacccaaaattttcaacatgttagtttaaaaaaaaaacttttgttccacaggtataaatgtttgaccaaagccccataaaagcttctgcaaataaccgtttcctagtttgccctctcagctcacggttttcagtgattcttctaatttgaacatggccctccaccccctaaaaacccaagtccaaaaccaattaaaagtggagatctgagcaagctaacctctgctgacttaaacaggatggagagtgttttatctagactaaacttgtaattactgtgttctacattccttgcctctatggccccagtgtaaaatgtgatcatccatttcaaaattatctctccatccgtgagcccaaagccgatcgtttagattctggtcttgtgttgggcgtcagtttgaagaatatcacagcactatctcctctaataaatgactttaacttttcacctagaagatatctgctttaacttatcacagggaatcatctgctttctttaacgcttccactaaattaaaatctgaagtcactcgatttgggagcgagtgttagctgcacatagacagcaggatgaattactagggagtcaatgaaaaaatattatccaaaaaacagaaaacttagtttatcaaaaatttcattttattctgtggatttcattaataatggccaggataatgcccacctacacacacatacttctgttcacccatgaaagaaggactcaaattttggtgaagtttctaaaccaaatttctaggttcatcagaacactgaattttaactttatatctttggatcattttctaattcttacttcaataacagggatttggaactacagaattaacttcaagatggaaatgttttcttctttaaaaactctcctgctaggggtaggaggagtcactgactattgtagttgtgcttcacagtccccagagagtagatcctacccagttccgatgcagaaccttagaagccggctaagatggcttcccgtatttcccaggaaaaaactcactaagtcttgttccaaattctagaagtaaagaggctcacttcattcccagaaaagtcctgcattttaagactgacaggtggccgggcgcggtggctcacgcctataatcccagcactttgagatcacaaggtcaagagataaagaccatcctggccaacatggtgaaaccccgtctctactaaaattacaaaaattagctgggtgtggtggcatgcacctttagtcccagctgcttaggaggctgaagcaggagaaccacttgaacctgggaggcggaggttgcagtgagccgagatcgcgccactgcactccagcctggcgacagagtgagactccgcctcaaaaaaaaaaaaaagaaaaagaaaaaaaaaaagactgacaggtaatcttaggctcatagttcttatcataatcatggcacaaaaaaaaggggaaagaaggggtaagtggaggcggaggttgcagtgagccgagatcatgccattgtactccagcctggaggacaagagtgaaactccatctaaaaaaaaaaaaaaaaaaaaaaaaaaaaaaaaaaaacagtaggaagaagattagtatggtgactttccaggcatgtaaagaaaaactatttcgttttattaaaattaacaagaagaggcactgaagacaacaggtaaagttataaattaaaataaacacttctctcatgtttttatataatagaaagtctaatgtaaatattgtagaaaaacaatgtaatagctatataatagctatgtgaccttgtacgaatcactcaacttctctgatttttgtaaaatagttatctctctttatctaagagaggtcgtaagtgcaaaaaagatgtggaagtgctttacagtcccacctggcttacagtgggtacccacaaaagtttattaggtcttccttatgaagacctctctttcagcaagatcacaatgacttttacacttaataaaataccttctgcaatctcttctacttttatatatagcctttctttgaaatagttgcaataaatatgcaaaaaagaacaaatgcttcctcacatagtttgaaaaaatggattcaaaatacagcagagggatttggtgctccacaaaagaacctcctgataagtaaggtttgctagaacagccaaatggactgacaaatgagaatgtacacagagttacttctttttcctgttttgtttctaagttaggtaaaagacaaagcagtagattagatatatctggagggagagcttattctcactccatgtatctatataattaaaagttctggacaatctcttcatgaataaatgaacttacaaagtagccttctattacttactaaagcaagtaccaataccattaccaatatcataagaagggcacatgcagcgtgggtgctcagagcttgctgagaagagtgaagtcatattctacactgaagggtctcaaagacgtgtgctaaaacgaaactgattaatctcttttggttgtagggattagatgactgaagattctagtcctataattttatgattttatggcttatattgaactgtgttaaagtctttgaacccattaagtaataagtgctttaataacagaataaacagaagaaatgtattcgtgactgcactgcttgacttaatgggtgattgggaaatgtcattttatttatttttcattttttcatgaaggatttcccacctttttcttcagagggctggttttcaggtctttctcatttctaggtacttacctctgttttcttagtcacatgtgattgttcaggaattggatagtgattgaaaagaacgctaaaagcttaagagccaggtaccatggggtcctcaaacatatacatacttgggtgaggacggcctgctagcatccatcgaggatcgtatggggtctttgtgggaacaaactcgatgattctgtctataggatcctttgagttcagaagaggaactgaactgtgcacgctctaaaaggagattggaagagagcacagcaatcagtgaacgacagccctagactccaactcagcaacaatagttacagacaaagacagcagggcccacgtatggaattgcacccaatagtcccaatcttcagctggaagaatcctacgtatgtgccaggccccaaggaacatgtataggtcaatagtctcatttaggaggctggcacaaagtggtgtgttttgactcttgatttcagtgtgcccatgctttctgggatgctcctctgaggaatgaatggctattacagaggagaaaacccacaatgaggaggaaccttaatatactgggatctgagccttaggtaggccatgagggcttccgtggctggaagacattagaaaggggcccaacaaatgaaatccagagacatcttaaaggtagaaggcaaaatatggctgtaaggaaaagagaaatcaatagctttcagagaaatattttataaaaaaattcctccaccataaagacaagaccttaaacacagaggcagtgagctgtggtggaaatgacaggctctgcaggccatgtcagtgctgggtaggaagggctcaccttgggcatgtaagacagccagtgcaggacagtgaaaaccccttcaaagtcatcacacacagtgcagtgggtcaccccattgttgtgcataatctggatgccccccagctggttattggaggtgtacacttcccgcccgaggacctagagaaaagagcaagagaaaagacatttgtctctatagaaataaaggcatggtcgatttcacaagtcgcactaaaatgggttcttttctccacaaaacagagatttcagtctccatgggttggttgttctgagggactatctgaatcttcttcctaaaaagaaaacttagaaaacaaaaaatatgagattgacgcgctgccagctgcgctaagagggcttactatagcattaggagatatacctaatgctaaatgacgagttaatgggtgcagcacaccaacgcggcacatgtatacatatgtaacaaacctgcacgttgtgcacatgtaccctaaaacttgaagtataataaaaataaaataaaaaattaaaaaaaaacaaaaaatacttttaacaatcacattcatggttgcaattttaaaaccagcaagcccctttctctccaccagctgccacagataggcaaagcatacttccaccctcagctgaaactgcagtggtgggtgaggctgagacccagaggcataggctacctcattgtgtgcaagtctctttgcacacagacacaaaaaggtaacatgcctgtctttcaacaatatttagtgacaagtctcagttaaagaaactctgggggcttaggttcctcatttttaaaaaggattatttttttccttatatttgatttttattagattggtgcaaaagtaattgtggtttttgtcatttaatggcaaaaccacaattacttttgcaccagcctaacactggcctccacgcacaagccctaaagctagcaaaaacctgaagcaactcatgatacatacatgaacccctgagtctcaagtcttctttgtgtgctgggtgcagggctgtgatttatacccaagcatgcttcccctcctccttcccttcccaggctccagggagttcagggcctcaatccctggtatatccctggaggaatttaatccttgtaaggtcaaagggcacctgcaattggaaaccacaaagtttcctttaaagaagaaaaaaagaggaagaaaagatattcctggacttggaaattgcagggtttctttttcccttgaagactggttaataatttctttcagggaaggaggttttctgacccagcagatggaagccgggcagcctgatcactgactattgcaaactgctgagtgtatagtaattgtcagtcatctaaggtagccccggagagctctaaacagttgtagagcgcttactgtattttaccttttctttttcctttcccctcctcctttaaaaaataacgacaatacaaaatttcttccgtacgtgtattcattttcagtctctggggagaatctaactaactaagggccagcaaagtctgcctgtatattcccattttgccccttcttgttaggagctttgagaggttcccctgcatgctgggtcagcacccccatcgggaccttccaaagatggaggaagttggtgaccaaagtaataacctcagtgtgacccaattggccttgattccatttaacttcagctaggaagggcataagatacttttctgaaaggaatatggaaagcaaaattgctctcagattactgttttccttgataaggaagcgcagagaacaagcctttacaggcagccccaagctgagcaacatgctggcagctcctttgaaggagcctcgtgaagagggaagacggtatctgaccactgagctcccatccgcctctcagtccgtctttaatctcagcccaggcactgcggctcttttctcattctcctgctgtctctttccatttgccctctctctgactgatacactgatctctcggtcactcagctttctgctctgctgagtccatattactaataacacctccgccacggccagtttacctcatgaaggcaggagcacatcattacaaaataaactcataactttgacattctagcaaatacacgccgtttgttatttttatggctttagtctttctaacaggcagagggcattacatacctgtttcatttatatctttaaatgtgcacacacatgcacactcacacatgcatcaggaaacaaaacagaacaaaaaatccaaaccaaagcaaatatccaaagcagtctgttgatgcgggagcctggtagaggcagaaaccctgtcacttacagaggccacgctctgatctggctctggttttatggtcgtcataaacccgatggcccacaactggtccttctgggacagactgcctctctgttagaaggcattcagtgtgatcagcagtatttttaattattaaaataaaattggaaagggggaaaaggaatacaaaaggagacactgtgctgaccctgaaaatctgatattcacaatctaggtcaggagccaagtactccttgttgcccagaagagagagctgggccattttctactcagaaacactattttcttcctatctctaatacctgataatgtccaaccacttagaatcttacacatctccaaaactaataatggaccaataaagaactacactcagaaaaagggaccgctcagctgtttaaacatactttcttctgatgtctttgcctcctcatttaaaagtgatcctctgccacttatctattctaccccatatttttacaaaataatgggaggcaaacttggtaggctcaataactgagtactcttctctttacaagctaaaactcgggttctgatgctttggcattgttctgaaaaggcagcagtatttctacatctctcctttcctatgtttagaagaaacctaaccagggcttaacataccaagaacattatttctgagctaaagaagtgtttgtcatgtgagaaaattcacttaattcagaaattaaggagaaaaattacagaatagactaagagtatcccaatatcactctctgaccagccttatcttgggagatggggggtagggtggggatgggcacagaaatgaaactgctccactaatcacaaacaaatgctaacaatcataactacttaacaatcggtgaagagaaagcagtaccctccagttcatcttcaatgaccacatgtttggagtatgcgccagtagaatgagggcgcacacaatagctcctgatttataggggtcgttgctgactcaagtggttttaatgattttagaatacttcacaacaaaagctccaaccaaggaagcagaatctgggttaggataaaatccattctgcctaactgtgaaatgatcatgctataacagttacacaaaccctcatcagtatctaggaagacgaatggagtccacatagacagaaccattgttttcttcctcaaggttgccctgctgaccttctacagaaaaacctggggtcaacaactctcatcaacatattttcatgaagtaggtgagctgcattcaacactcttttaaactttgacctacgcatttcttgccgtgtttcagttcccaaatatattcctcttacattctacttactgtatgatacaaacttttaatttatctgtccagcaagcatcaataatcatttaaacacaggagtgagtcaaacagaggtgattctcctgaggcctcactttcttgccctccagatctaagtggagaagcagtaccatgcaatattaggaatgggctccaccttggggtcctctgctgaagagtgccatgctgacagaattgaataagggctgaatctgagaggaaagaggatcttgactcattctcaatataaacttaagcctcatccagtacttcattcattgcagccggcggacctaagaattaagggcaccacataaaagccggtgattagcagagacacaattgttaaaggctccaccaaagatgctacgtagcctttagaaatgttgagatacataagaagtacaaatgaatgcagtcatacgtccatgctcaggcctctgctgctgctgctgcttatctagagacactgcagacagctcaggtttaccacagctgacaggcaatgaaaacagcctaatataccgcctgctctctcccttaaagccctttttggagatcaagataaacacgtacttcctttcccccatgctccagacgtttgactgaagtggcagagcattgtgatgttttgtgcaaatgaaatcactatgtaatactgaatgagtgcagtatttacttgtcaggatatttgtcagcacaggcattgagatttccaagtttcacagatgcaacttagctcaattttttaaaaattgcctttgtcctgacatacacattatgttggggacccttagacttataggcaaatatttgcaatcatgtgctgaagatgtgaaaaattatcatgcatatcaatgatggaataaaaaatgaaatctattccttctcctcctctttattcagtcttttccccctctttaaacaatgctcggtgggtcaggacatctatttaaggaagcagggaatacaaaattcctcctgcatctaagaattaggctacacaagctgagtcctcgctgcaatcctccttcttattaggacatttccattctcaagaggatttgaggaggggttttgtaaatttactgagtaattgtcatcactggacttcatccatgattctagatattaaagtcactctgggatctgtcaggttattgataaaggttggctaaagctgaaagagaacagatatgagaaagaataagcaggagtagaggaaaagtggtaaaatagggacaaaagaaagaaggaaggatgagagagaggaaaagggagggggagagaaaggaggaaggagaagaaaaaaatgcaatagctcatctactcagtgcagctaatatcctcctccctgacctgagaggactacattttaaaaatctgacaagtaattcaatctccaattaacaattttaagtggtgctgcacatatcactgtgtcaatgtttcttcaggaatatatccaagggtgaatggaattaaatctctagggagatggaaccaggacctatgtgaccaacaagattatttgggggttccaaaatacagtttcttaatgcataggcaaagggttataattttttccccactttattgccactactgtcactggcaaactggagtgctggctggcaggtgctaggctagggttggggtagagaaggggctcggtgacatactgtgggcagaagagagaaaagcctctgacatgagccacagctggattcaagaccatttgctataagaccaaaaatctctctataagcagcaaatcatgaagtgatcaggtatgctgaaggataaactggggcaaaggggtggtactgtcagtggaaggaaaagaaacagccaaaaagaggctgaatataggccagaaataacactggaagacatctctttactgaggtacagggctcagtggagaacagaggaatgaattagacagcagaaagacaataaggatttgaaggtggagtgggtaaggaacagagactcatttgtaatgtaaaagatagagaggagccacacaatagtttgctaaatgtatgagaagaagcacaggcttctggaaagaaagctgccaaaagtaatcactcaccctagggggacccaccaactgctcatgtaggtagggacttgagatttctgataagttaattccaaacaggaattcttttttttttttttttgtagagacaaggtcttgcacgttgtctaggctggtatcgaagacctggcctcaagcaatcctctcgcctcagtttcccaaagtgctgggattacagacatgagccaccatgcccagccaatttttaaaaattttaaataaagtctggtttattgaagtataatttacatacagcaaaactgtccatcataaggtatacaagtctgtgaattttaatacacatagtcatataaccaccacaacaatcaagatagagagcattttcatcatcccaaagtctcctcatgttcccttccctccctccacccctaacaaccattgatctttttgttccagtagttttgccttttctagaatgttacataaatggagtcatacagtacatagccttttgaatctagcttctttcagttagcatattgcatctaagcctcattcatgctgatgcaggtatcagtagtttatttttattcctgagtaatattccattttatggaagtaccacaacttggtaacccgtttgcctgttggtgtacatttgggttgttttcacttttggaggattataaataacactgctatagacatttgtgtacaggttttaagaaaagcccaacctttttcaaagtggctgtgccattttgcattcccaccaacaatctatgagagttccagctgtcctgcatcctcatcaacacttggtatttgtcaaacattaaaaaaaaaccatttaggccaggcacagtggctcacacctgtaatcccagcactttgggaggcctaggcaggcagatcatgaggtaaggagattgagaccatcctggataacacggtgaaacctcatctctactaaaaatataaaaattagccggggcgtggtggcacatgcctgtagtccctagctacttgggaggctgaggcaggagaatcgcttgaacccgggaggtggaggttgcagtgagccaagattgcaccactgtactccagcctgagcgacagagcgagactccgtctcaaaaaaaaaaaaagcaaaaaacaaaaaacaaaacaaaaaacaccatttagtggtgtcaagctgtggtttaatcttcatttccctaatgactaatgataagcatcttttcatgtgcttatttaccatccttatattttctttggtgtaatgtctgttcaaatttcttgcccatgtttttaattactgggttgttttcttactgagtttgagaattcttttggataccaatcttttatcagattatgtattttctaaagatggaaaacttttaaaaaaatccctgtttgtcagtcgcctcctactggttttactgaataggctgtgactgactgcattgctcaccagtgtccaggccccaagagtatggtgtttgcagggcctcgctcttaggggagtagcactgacttactatctctgtggccttttggtttgtgttttctcattgacgtctgatgggcagcaattttattttttcctttagaacacatgaaaggcctattattgtcttttagctaaatttcagctccatgaaagcaggaatcatctttgtattgccacagcataagaacagctttatacctaacaggcatgcaataaatgcatgtgatctaccacatttctatgtattctataaaacctcaactgattagtatgttcagcaagttaaaccactataagcaaaataagtctttcatattagtgttataatgtgtagtggctttctgaagcaaaaggagtggttcaattttcctacctttttagttttccccaatgtagatgcccctctccctccctccctgtcaaaattctttacatgggctaaaattaaactagtaattctaagtactataaagtcatattatgttaggaatgctcttctgagctgcataaacctgctttatctattgagaaaggcatattttaccaatgggtcaggtagaaaatgaagttactcaaaagttgattacatgttccaatggtcttgacttctcatatttgcatcttatgctgttggttaaatttgggtgggttcttttccttaccaacactgatttctcaatttcttagacgcgcatactattttagaaggcttaaatcccagacactgagacattattaaaattaggaaccggtcaaaaatcagccagaaaatcttgaagcccaggcatggtaatctgtagttcaatctaaaaagctctttaagcttctcctttcataattcaatattcctgactgtgtacattagctgattagactgtgtgatgatggccaatctgaatgagaagggacatagctagatttggatccatgcacagggaacattccctagaatgatgaacagctaggagtcaggtttctaaacagtctcatttccgcttctttatcatattcatagaccagtctgtgcacagccagggcccagctctgtcttccttctagaaaagactggagtccttgcatttctaatctactaacgtgtggttcttgcacttttaatttatgagtgttaagggggacctttctgacttgggaacatattggctcggtctaatgcttggagattattaaacttggagctatgctccactatcaagtctacagatcttttatttagaagatatggtgctctaaatgcacaaagagctccctgtcaccttcacattaaagcccctagtgcctggtaaatggaattatatagctgtcatctcctttccccaaagttgtaagagtacaatgggctcattttttcacactccatcccagcttcagaactaagagacctactttgtattgatttaaggtctcagaaataaataaacctgcttcaccactgtgattcacaacaaattcatgatacactattgcatgatatatttcaagctcttgctctggctctctttttcttctggtgagtaatgggggaggtgggaggtggtagggagctgcaaagctgacagcctgatggttattggagatggttgctgactgcaaatccaagaatagacactgttggaggagtacgggaatttttttacaactagggggcaggggtgataagctaatttacttgggcttcaggctggggttgggggagaagaaaggctgaagagaggagaggggttgacagagtagcaaagcttcaagtgagcactgatctgcaaagacagagctatgaatatatgtagaaagagagacaggtgaagaaaattcaacatatgaaggtgtaacacacaactgaatataaaatgaagaagacgaagaaaccaatcttcctaaggaaccgtgtgtacagagctaagtgggcccttagcttgagttcagagacaatgttttattagaaacagacagtgtagagaccctacatgccacccaaagtgtgaggtagaggcatttcttcattctaatactcaggacacatcagaaccctggaggtggaaatggacaatggatatagggtagagatataatgaaggtccacatggatgaagtgagccagagactgttcactgaggcaagagggtaatacattctagcagtttagcttgtgtttgtgtacccttggggtttgagtacctaagtctacatcacctttactgattccaccaaatcttaggcccaatgagttttagctggtatctacaaatatagcagtcaaaaagaaatatcctccaaccttatttcaggatctggactttcaacaaggcagaggaggagaaagcaggagataatcgggctccgaaggtactgcatggcactgcaggagacccctaaggttccaaggagtacttccaagtggaattaagttttaactgtttctcttgtttcttctacttatttcacatttttaactggcaaagttatttatgaatccaatttcttttctatcttggaatagcattttcatcttcactacatttgttcttgagacaagaccagactctgaacacaaaagtacatgagaaagattttggttccattcaatttccaattggtcatatcacaaaactgggagtttctttgttaaatttgaacactgtctttaaagagtgatcagtctctgtacagggaaacagactttagccaaatataaaaaagaattcacagatgaatacatagatgaatgggattggctccaaaagtactcagctcccattcagttgaatttttcacacataattgggtgaatatttagcaatggtgtcacagaggagattcacacaacaattgtgtggttgaacttttgaggatcctcccactctcaagatttataattctacagccacttgtgattgtgaacaacatatagtgtttacttttctgtaatctggataagaaacaaaattaaaaaaaattttaaatcatcatgctcttcaacttccattcctggtctcacgagtatgtaataattttatatatcactaatatgtaattttatatataataccctaatacgcaataactttaaaaattccccacctcctatctattcactccccagcctaaaacagttccctggctacagatcaatatgcatctttatagcatcacagaatactagatattgaacagaatttaagattaagagatcctctggtcttctacttaaaaaaaacaagcaaaccaaaaacaggcttaattcactttatttttcttatgtaaaaactctgtgttgtagccacagttggagcctgggtcccctgcatggagactctggtgtgggtcttgatgaggtggtcagtgaattcctgacaggaagacttgatgaatacagtctccttccagaggtcgggggtcaggtagctgtaggttttagagatggcatcaaagatggccttgagaaagttccctagggtggcagtgcagcccctggctgaggtgtagcagtcatcaatactggccatcatcagcagcttcttgggcaccagggccgagatgatgccagtgccccgggtgcagggatgaggcgcaccagcacagagccacagccacctgtcaccttgcaaggaatggtgtgggccttcttctcccagtagcctctgtgcatggggacaatgaagagcttggccaggatgatggccccatggatggcagtggccacctccctgaagtacttaacacccagaccaacatggccattgtagtccctgatggcaacaaacatcttgaacctgatgtgctggcaagcacgcgtctgcttctgcactggcataatcttcaaaacctcatccttgagagaggtccccacgaaaaagttagtgatctcagattccttgatgggcagggagaagagatagatctcctccagggacttgatcttcatgtccttgaccaggtggcccaacttggtcatccattccttgccctcagccttgcctccatgagctctgtggggcccaggccctgttcacggccatggtcccagccctggatgccactgccaaaggttccacggttccccatctcaggcacccccacacctggctaattttttaattattttgtagagggggtcttgcttcttgctatattggccagcctggtcttgaactcctggcctcaagccatcctccttccttggcctcccaaagtgcttggattataggattaccacgccaacctgattttctactttaaaatgggaaatgtattatgccttccatttcacaaagaggaaactaacatctaaatagattaaagcccaaagttgcttacctagtaaatgtcagggagaagaacaatcaaaagttttttgtttttttttttctgagatggagttttgctgtttttgcccaggctggagtgcaatggtgcaatcttggctcgctgccacctctgcctcccaggttcaagtgattctcctgcctcagcctcctgagtagctgggattacaggtgtgtgccaccacgcctggctaattttgtatttttagtagagacagggctttaccatgttggccaggctggtctcaaaccactgacctcaggtgatccgcctgcctctgcctcccaaagtgctgggattacaggcatgagccaccatgcctggccaagttttttttgttttttttgtttttttttttttaatctaaaggttctgtaactccaaaaaatttgagcacattcataataggttgtcaaacatgataatttccgagtctgtattcaatgccccaaatagagtctcagagctttcactttatctagaagctctggactggtacttgctgtagggtctcccaaattcttagactctaagccaccatatatgcatgggctctcttagagtcagagacaacttctgcagtggagctctgtgtggcgattccaccctgcaagatctccaaaccagagcactcaggattgttggcaggtcactaaggcagactaatagagtcaaaacataacctggtatagttttctaccaaacttgaggaatattgaatgaaaaacaaacaaaataatccccccaaatggggccagatttaccaatattttatgtgtggggagggagcgcttgaaaattagggagatctgtccattgtgcaataatttctgagaattcattcataatgctaaagcaaggattactcagaaaggaagctaaaatgccctctttagaaaggagagtgatcccatctggagctatgggagtacagggactgtctattgtgaaaataggtagttagggacttttaaaaatgcaaattgctagactgatccttagagtgattatgagctattgtatcaacgagtccttggggactcttgtagacagatgactgacatatatactaccctgtcacgactgaacatcgtgcctctcacattaatggctttccaaagtgcgttgattgttgctagatacatctattgggaaagtcaatacatgaatgtactgccacagtgaggactgtcatctaacattttctggaagaaatttttgccttcaaagaatcagaaagtatagagaataatgtgttcgtatttcctttccagaaccaggataagaaattgcaatgagaaggaaccctaaatgaaccttagagaagactatggcagtgccaatgttttacctattttggctcatttaattctcacagcgactctggtacacagatactattattactcatcttttacagttaataaaactgtagcccagagaggttaaataaattgcccgaggtcacacaactaagtaggtggtagagccaagaattaaacctgggcagcctggctctagcctctccatgctcataacatcttttttttttttttaactaataaaaaaattgtaatttacttagaagcattcagaatgccaacaaaacagctgcaactttttttttttttttgcaattacagagtggtattcagttaacagaacaattgtttcatataagctgcatcagagacaattgaaaatgaaaaaactaccaaccccatatataacttacatgtgctgtgcaccaataagaacctgcttaaaatttttatgccaatttacaacccccatcctgtaccaggcaaggttagtggctatgaaaataccaccaggacagggctatctaaagacacttttggtagtgtgttaactatacaaaagaagacaccatacagtttaaaaaaattcttacacagccttacatttcaatttttttctttaaaaggagtgagttgtatacaggggggttaaatgctttatagacaagaaaaaaatctgtgctagaaccaacttattcatcatcatcatcttcttcatcttcctcctcctcatcctcttcatcttcctcatcttccttgtttttcttgctttttcggccttggcaactcccttttttgctgcatcaggctttcctttagctcaatatgcagcagtatccttttcgtatttttccttcagcttcgcagccttcttttcataaggctgcttgtcatctgcagcagtgttattccacatctctcccagtttctttgcaacatcaccaatggacaagccaggatgttctcctttgatttttgggcgatactcagaatacaacaggaagaacgctgaaggaagcctcttgggtgcattgggatccctgaacttcttttttgtctccccttcaggagggacgtaggttttcatttctctttcataatgggtcttgtctgtctttgccatatcttcaaattttcccttctgtttagcagacatggtcttccacctctctgagcacttcttagaaaactgagaagttgactgaagcatctggatgcttcttatgctcctcccaacaagtttgcacaaaaaatgcgtatgacaacatcttgcctctaggcttcttaggatctcctttgcccatgtttagttgtttttccacagcgaggcacagagtcacccagtgcctgtctggctctcgcttgccccggcgctgtctctatcgtaacctctttaagttatgtgaaagttacaatgctgcccgccccacagtgagagctaagtaatctctccttcccttcttgagcctccatgactttcatgctgtgtttcacagagtcatgggtgggtgagcatggagactacacagtgcaggtccctggtgtaacagacaattcccactcctgagaggaactctggtactgtgcctaacagagtcagctatgacaacttcacatttcatactgcatagctgcagaaaaatacatatatgagaaccagagagaaatgtaacttacttgcaccaagtctcaaaagcaagattagcagaattagccccctaccaaactaatggccctagtcatacccatcacataacttcttttttcctggcagattcagtggaaataggggcctgatctcgctaagggggatgagagtataggatttttttttttctaaaaaagaagcagagctttaaaatacaagaaaagtcacatatcatctcccggtgaatctatcacctgcatatcactgcctttggcatataccttaccttcacagtcagttaatgtccacaggacaaccataaactgcatattcttatttctctggatagagaatgtgctctctctccccaagtctggggcaatggattgagagctagtaggctccagtacacatcagtgttcctttacaatactagctcttcccagcctatctgccacctaacactatgttaaacatactaatacttttaccaggaaagggagaaaaaaataaagtaaaaaggaaactgagaggaagagtggtgggaggagggaagtaaatatgatcatctctgcaaatgtccagtggcaaatagacttaagagtttatgactctgcaatcatctcagctccttaagggtgcatcttaacagttccccaagtacacaggttactgcctttgccaggccagcatgactcccttcaagcagggtaatttgccacacacatcaggtctgccacgcagtgaggcattttaaggaatctgtcacccacagcctacagttcctagagttaggatctactaccttgagtgacatgaaatagcaagcccctagaaacttctcttattaatgtcatcattctcacgacatttggacaaacaggaaaacgaccggaccaccttctcttaggctttacagaccactaagcaaagaggcctgagctttcttcagtgaaacttagggacatgaaagttcatgttctgaccctgatctagtctctctcaatgaaactaagtcactttcccttctgtttttgccttcctgtctacgaaatatagccctgataccattagcccattccagaagatagcaaggaaccagacagatattcttgactgaatttcaagcaaacccacttgggctgcttctaatcaccagcctactgcctttagttctaatgtcaaatgtgcttagtaacactcaataaaatccagatactacaactcatctcaatttgggtaatattttgaatattttacaaataactgcaggcaacaaagcaagacagacatggaaagaagatacacaaatggtgagttcacagggggaaaaggataaaaatacgaaggtgggaagcacttcctggttttggaataaaagacacagtgacaaaggatggcgtccatgaataaaacatgtaagtatacagaaaaaccaccaaaagtaaaaaaacaggaaaacaccagaaaatatttattttatatgaaggttactactgttggctataaaaagaaatcctttaaaaagtaagagtctttggaagcaaaagataggaaggtgtaaactaattaaaaacaggctaatgacaggcaacatcatgtgtatgccaagatggagtatagccataaaagccaggcgcacacatgcaatgtattaagttgaaaatgcatgtctcttcagcttcatatctattaaaggaagaaacaatttacaggttgctgcattatgggagtatgatatgtggagtgtcaaccttttctcttcaaactgaaccatgttaagtaaaatcaatgatggggtttggggggtaggggaaggaaggggaaaagcagggagaaagaaagtttttaaaaatctctgcctcagcaaaagttttcattaaaattttagacaaatcatccctgtgtccttctcccttgctgcctggggctccatgctatttctatgcaaataacaacctcgtggtttatatcttattatttccaccggagctgcagcgacatgacctgagatgtgtaagaggtgggggggaaggggggggcagaggaggggatttggagaggagagagaaagggagagaagaaggaggggggagagagagagagagggtgttcactcaagtgtgaaaaaatattgtcaggagtgagcatcaagaacaaaaaaaaattgcagggataacgtgtttatttcagtcccccccaaaaccccccaaccccccttcctgcaaaccagcaccttttaaaattcattgggcatcaggcgatcatgcacaatccatctgctttcactttatcatttgcatttcatgcctcctggcttttgatgtgctgatactttgatgcagtcaggagacgtgcattatcattatttcaattttcaaaggggtcaacaggatcggcacttgcacacacaagatttttttcccctacaacctctgaacacccccactccttattcttcaccccaatgtttaacataaaggatgaagactcaaaaatgtgggggtcaaatatttacagtctaagactgtatataagcttgcatgtctcctacatttccaccttacacaggtacatactatgagcaaaatggccaaggcttaagaaaggaggctctataatgtttcaaaaacacaaagactttctcacacatgaacacacagggcggcacacagacagagaaagagggggatctatacgcaagacacagacacaaagagacagaaagatcagcacccacacagaaagagacatgcactcagggtgacttgcacacacccaaagtacacaatacagagagatacctacagaaagaaaggcaaacagagatgaagaaaaacaccagcacacacaaagacaacacacagaaggagtgagtcagaggaagccatctgagcatggtagtttccttttttcataccttataggcaaaggggctaataggatattctgaacgaatttgcataaaatcgggtgtcttcagcagcacagctctatacttaagaggagctgacatgaagatagtgaagcaggcagagcaacattaggtaacctctgtatctgatcactcccttcagctaaaaacaaatatgcccttttggaagtgagcattgtttggtaagttaaagctatagctttatttatctttcaccctgtaactaagcttttgttttaacaagcagccctgtaagctatgacagtgaatataatgaatttgattagaacaattcaatcagattttaagaaatcaatctctaatgtttcttcatggcacaaatgaaattcaactagcaagttttcaagcaaaacaaaaccaaaaacccaacatctgctttttgtaatattctttgtatataatatagtatcggggcaggggggagaaagaaactcaatataagaagatatatttcagaaattagctctctgactgggtatgggaacatcatggaaatataggtttttaaagtaccattatctatgagaacagaatttttaaaatctttcaaaaattctgttctcatagataatggtacctaaaattatctttggcattcatcaatatctcatcctaagaaggtatccaaaagagcaacttaaaaaaaaaaaaaacaacaaccttaagactctcagcagtttctcccactgcaataataatcttcagtagtagtggttcacaacctttatttccaggctactctccaaaaagggaggaagacagccaagttcgccactgttagcactgctgtgcctttccttgatgagaaaagcaagcccagaggaggatacagagttcatatgaatgcacagagcaagctgatcgcatcaaatgattcctctaatttctgacatccacaaaatctaattaaaccaatggaattatcaactttttcctaaatgggaatgacagaacacttaattcttacccttaaacttgaaagtcaagacttgataaaaagttcctgcaagtggagtaaacataatatctgatacaatttagtatgtgtattaactccataagctcaatcaccaaatcatgttagagagaggaacgggaaactgaaatttgaatgtgggccaacactttttgccaagaactaggtactctttttttttttaagagatggggtcttactatgttgtcaggctggattcaaacttctgggttcaagctatcctcctgtttcggcctcctgagtagctgggaatctaggcatgcccagtagaactaggtacttttacttatgttttctcatttgagctccacattatttaaaggtttaaattattatccccctttgacagataagaaagctgaggagctgagaggttatataagttgcacaagggcagtcagcctcagaatattccattatacttttctggccctgaagagaaaataattttcctatgcttgcaaagatgtcagaactgcactgtcctttatacattcaggtattcttggatagttttcactctttcgagcagtgaccttgccatccatttttttcccctttggaaaaacccttgtgaagttggactaaaaaggcacaaatctttctttggaagggaagataaatctttatgcatactctttcccagtaacccatccatgcatccatccacccatcttcccactcaatatttgccaaatatttcttctatatacaagagaccaccatcggtgcccttttcgagaggtgtatttacagatttcacaaaatcattaaaacttgatagtctcaacacctaggccggtacctaattcatgatgtaggcctgaaatgggaaccagcacagctggaatcagagacagctcaatgtctgtgtatagatctcctcacatcttttactaatagattaagaaaaagagagaagtgggacagaacagaagcgttcaattaattctgtctttctacaacgacactaaaacataagcactttagagcagcggttttatatggtttgttcactaacatatacacagggcttggaacagtgcctagaaaacagtaagtactcaaaatagttgataaatgaaatgaatgaatgaatgaatgaataaaaaggcaagcaagtcaatgggcagaaaagatggagggagaggggaagagatagactgaggaaggcacggattgaactgcttccttccaatcaggatcttgaattaagaattcacacaataatcttcaatcagctatgcatacttcttcaaaaccctagaaacttactttgttgagggctccagctcctgttagaattaagtgagaattctcaacctggatggttctctgtcccagccggacaaggtaagccccaatcccaatggcccggcacgtcaccttagaaaagaataaattctacatgtcacatatttatgtcctctctgaagctataagaactaaggcatagataagtaaaatccaaattaacagaaataaacattgctttttatgaagtctatttgattgacaacaacacacacacacaaatttcatggtcaaagaaaagaaaatacaatgatgcaaaattcaggctgggtgcaatggctcatgcctatcatcctagcactttgggagtctgaggtgggcggatcacttgagcccaggagttcaagactaccttggggccgggcgaggcagctcacacctgtaatcccggcactttggaaggctgaggctggtgaattacttgaggtcaggagtttgagaccagcctggccaacatggtgaaaccctgtctctagcaaaaatacaaaaattatccgggcgtcatggcacgtgcctgtaatcccagctactcgggaggccaaggcaggaaaaccacttgaacccaggaggcagaggttgcagtgagctgagatcacgccactgcattccatcctgggcaacagagtgagactctgtctcaaaaaaaaaaaagacctacttgggcaacatagtgagacccccatcactacaaaaaagttaaaaattagttggaggtggtggcacatgcctgtagtcctagctacctggaagctgaggtaggaggatcacttgagcccagggggtaaaggctgcagtgagctatgattgcaccactgtactctagcctgggtgatagagtaagactctgtctcttaaaaaaaaggaaagaggggccaggtgtggtagctcatgccggtaatcccagcacttttggaggctgaggcgggtggatcacgaggtcaagagattgagaccatcctggccaacatggtgaaaccccggctctattaaaaatatgaaaattagctgggcatggtggcactcgcctgtagtcccagctactcaggaggctgaggcaggaaaattgcttgaacacgggaggcggaggttgcagtgagctgagatcgtgccactgcactccagcctggtgacagggcgagactccatctcaaaaaaaaaaaagaaagaaaataaaaagaagttacactaaaagctaaaacaaagtgctgggtttgtttgaaaaattcagttatttatattatcctatcttcctattatcatgtgtgattaaaatataattatagacatacaatcttcaagaaatgctctcatttgggactgaatagcagtgataagagaaaaaaataaacctagccacacagccagttcttcaaaaatttcacattctggaaagatttaccaggctgatggtaatgatctcattataggccaatgaggattctccagcaatcattccagaacctcgaaggttctcgggtccaattccctcttctttcccaataatatctgttatcttgtacctattggatatggccatgtcaaattatgaatgttaaacacagtaacaacaagccattaaaagaataatcaccaataaaaggcggctaaaagtgtattgaaagcttatatttaatgccagggctttatgtgcttccttttatactcttcattcatatgtctttccttcttagcttggtgcctattttacctggaagcaacatggtttaatagaaagagcgaaatctggaattaagcagatagccttttttctttttttttgaggcggagtctcgctctattggcaggctggagtgaagtggtgcaatcaaggctcactgcaagctctgcctcccgggttcacgccattctcctgcctcagcctcccaagtagctgggactacaggcgcccgccaccacgcccggctaatttttgtattttcagtagggacggggtttcaccgtgttagccaggatggtctcgatctcctgagcacgtgatccgcccacctcagcctcccaaagtgctgggattacaggcgtgagccaccgcgcccggcctaatttttgttttttttagtagagacggggtttcaccatgttggccaggatggtctcgatctcttgaccttgtgatccacccgcctcggcctcccaaagtgctgggattacaggtgtgagccaccgcgcccggccaagcagatagatttaaatccttgctctgatacacacaggagtgtgactctagaaataataataacttctacaaaatgggaataataatatctacctctaagggttgacaagaaagttaaactaaagcaaacaaggaaaaggtttgatgttatagatggccctcggattttagatgccctctcttattttctagaacaagtttcttaaaagcaaggtcaatgtatatctctataatgagcaaaaggcatcatatcaacaattttagacaattttacgtaggaaaagaatatccaaacagagcggtagtgagaatgctcagcttagtttctcaagtcaaaaatcctcttctaaggtaggatgaagcaaaggtcaaaatactgaactcccattcatactccttcataaatatcaagtatatacacaagggtccctggatatgtcctctggaggggaaggtggaatgtgtgtagaagtgaaatgctgaccaagttgtccagaaagcatcctgtggatctagtgggagtcactcatctgtcttcctggcaggggattaggagtgatagctgataatgggaaatgggagatggggaatgcaactaataaaagaaaggaaaaatacaaagttggaagtagagatgggcatatattatttattgttccacgtgtacccagaaggcttggcagtgggcacagttttataaattgaaataataaataagtaccccatagtggctcttaaaatacttcctcctgcccccatattttcctgctcccttcttcatttccagccctccatcaattctttttctttgcccttgctgttggtctgtgactttgcatctctgcttcccagattctgctgcctttctatttttagcctctcctaatatccaataatttcccagttcttccttttgttctgtatctagactctatcctaaagttatgtcagaaatgaggctactgtcccttaagggggttaattaactacattaattgtatatgtgtttgtgtgcctgtttgtataaggtccatatagtcataaatattcaaggacccagccagacttgcctgtaacaaactcaatattcatagattccagaaatgaagagttaaaaaatatcataggggaaaatcccattcagagtagcaagaaaaaatgcaaaatatttagaaataagcatgaagaaattggcagaatctcaccgtaactatattgtgtctcagggcaccatgatgaactcccagaagcactacaagatattttaaatttttgagagaagcactattatatgtggtatctgtgaccctatgtgaactactagctttagatagttcatagtagttcacagtttaacgttagaatggtgctacattccttttgaaaatgtcctgtctttgcaagctagatttttgaagtttctgtgaaaactcaatgaagaacaagaaatgtgggtggctatatccaagctgattccaaggtttgagaggttatgcagacacaaatatctcattagtaagaaactgtaattatttaagaataaattttttcgatttatgtatataattttttcaaatgattattaagttcttaggacgcaaatacttattgtttaactacctaataagcagaaatattaagtatatcttatagcccaggggtgctatgaaaaaattactgagacactaaggatgccatgaaccaagaaagtttgggaacctctggcaaaacctatatgaagaaaactacaaaacgtaaaaacaaaacaaaaaaaaccccactcatataaatggaaaaacataccctgtttctttttggggaaagttagtattatgaagatgtcacttcttaaattaatgtgtaaactcaatacaatctgaatcaaaatcattatggaacttttttggaattagaaaaacatgagactctagccaaacacagtggcttgcacctgtcattgcagctacttcagaggttgaggtgggaggattatttgaggtcaggagttcgagaccagcctggggaacctagcaagactctatctctaaaattaaaaaaataattagctgggcatgatggcacctgtctatagtcccagctacttgggaggctgacatgggacaatctctgaagctcaggagtttgagggtttagtgacctatgatcacaccactgcatcccagcctaggcaacagagtaaaaccctgtctctaaaaacaaaaaccctctacattaaaaaaagcaaaagtagccaataatacttgaggaaaaattaaaaatgtgagaaaatttgcctcactagaatagtttaaatagtgtggtattagcccaagagcagacagacagaacaaaaaaacacaaaagagtaaattttcagtaaatagtattaggacaattaacttttttttttcttttttttgagatggagtcttgttctgtcacccaggctggagtgcagtggtgtcatctcggctcactgcaacctctacctcctgggttcaagcgattgtcctgcctcagcctcccaagtagctgggattacaggcatgtgccaccaggcccggctaatttgtatatttttagtagggatggggtttctccatgttggccaggctggtcttgcactcctgacctgaagtgatctgcctgcctcagcctcccaaagtgctgggattacaggcgtgaaacactgcgcccagccaagcaattaacattcttaaaaatacttgcagatagattatataaaaacattcaacttcactgggagtcaaaaatacaagttaaaataacaattgccatttttattccattttattaattgataatcaatgttggcaggggtgaagaaaaattaaagagggaaacaaatcctattctacactgctgacagaaatgcaaatcttgggaaggcaatttaaaattattttttaaaatccttaaaaattgacttttcgacctgcaatttctcttctagaaattaaccaaaaagggatgatcagagcttttaattcctaaaagtttatatgaaacttatataaatgtcccttaagtgggttcagccaagggatgtgaaaaattagaaatagtctgaatgttcaaatatatttattataataaaatactatgtagacattaagcatcatattcttaaataatgttttaagaatacacgaaatttccccaaaaatagtttttagtgaaaaggataaattataaaagaaattcttgttatcatctcaatcacatagaaaaaagatatgtctatagaaaagacagcaagtgtataacataaattcataatcgtggcctgaaggtgggattgtggctaatttttttttctttataattgtttacatgtttcagtttttctaaaatgaattaagtattataaatttaaaaacttcaatcaataacccaaggttcttcagctaataagtggtagagctggatgtaaacctaaaacatctagattatgtcatcttcaatgttcttcaaggttatgaacagctgtacaatatggaaaaaaataccatattctcctttctttagtcatgaccaaattattccaatacatatatacctacctggattctccttcatcttccacgtgttcacaatggacagagttgagagcactgactctcttataatcttgaggagtcagatataaatacctgtatccctgtgaagcacaaatagtttttaactcattatttgccattgtcatataatcagaagatacagcaaagcatacataatgaagcttgttccacagctagctttaaattgccacatcacttcttaggtttactgtctaacagaatactagcacagacagtcctcctttgaaagatgaagtgcctattttttcactcactaactgtccttgaaacaagacaccttatagctgcaattccaagtatattcccttcatttcattttctttctttctttcttttttttttttttttttgttgagatggagtctcactctgttgcccaggctggagtgcagtggcgcgatctcagctcactgcaagttccgcctcctgggttcacaccattctcctgcctcagcctcccaagtagctgggactacaggcacccaccacctcgcctggctaattttttgtatttttagtagcgacagggtttcaccgtgttagccaggatggtctcaatctcctgacctcgtgatccgcccgcctcggcctcccaaagtgctgggattaaaggcgtgagccactgctcccggcctcatttcattttcaacagggttaaagggtcattttctgatctttagtgacatctcttaaagatatcaacatgtaattaaagaattgtgtgaattactatttttcactctctcaaatccacaggatcatcaaaataaatataagcaagggataacagaaaaccgcaaatctaggagattcaatattaaaatcagaagtctacacagtgctaatagtgaacactgaactcagatcttttgttttttcaataaacaactcctaatgcccatttacatgtaaacaattatactaacatttcataattgatttatatgtatctatacacacagccacatacaaagtagagttacatggtatatgtgtttaacttaagtgaattagtcactcagtcaaaaaaataagtaaacacagggaagcattttaaatactatgagaaattatgcccaccatttaactcaataaatgtatgtcccacagtgagcacaacatggaaaagacataaatctgcgattggtcttgcatgatttgtgttgagaatgcctgacagcactgagtgtcattagtatgtcagtcagtacacatttactgagtgcctattatgtacaaggtactattccaggcactggaaaaacaggaattaacaaaaatagacaagaattcctacccttatgaaacatacctcctactcggaaagtcaggaaatacacaaaataagtaaaatgtataatgtaaatgggaataacgtttaaggaaaacaaaatgaaagagaaggtagacagtcgaacttttagaaaaaataaccaaggaaagcctcattgaaaagtgtcatttgagtaaagacctaaaggagctgaggctatgagacatgaggatatctgaggaaaaagcattctaggtagaaggagcagcaagtacaaatgcactgaggcatgatgtgcttcgcaggtttaagaaagcagagtcgggtagagccaatgtgtggaatggtcaggggaggctgtagcaagaaatgagggcagagtggtactggaaagccaatctatgtaaggccttgtaggcaactatatgatctttggcttttacttgaatgaattgggaagctattaaagggttttaagtggagaaaaattttgtgatctgatttatattttaactagatcattctatcttttttttttttttttttttttttgagcagagtctccttctgtcacccaggcaggagtgcagtggtgcgatcttgactcactgcaacctctgcctcctgggctaaagtaattctcccacctcagcctcccaagtagctgggattacaggcatctgtcacaatgcccagctaatttttatatttttagtagacagagggtttcaccatgttggccaggctgttctcgaactcctgacctcaagttgatccatctgcctcagcctcccaaagtgctgggattacaggcatgagcatgagccaccacacatggcctcattctacattctgttgagaacagaccttgggtggggctgggagcaaggccagaggcaggaagaccaattaggagggtactgcaatatgcaggtaagaagagttagactactgctactgctagtaagtagctgtggaatttgttagaagtactcagattctggatatattttaaggtagggatgtaaacatgatttactgtttagatggatgaatggggtgtggaagtgaatgtggggtgtgcaagaaagacagaagtcaagaataactccaaggtcttttacttgaacaaatgaaacaatagaggtaccatctgttgagacagaagactgtgggaagaacacattaaaggaagattagaagctacaatttaggcagacatttaggcagatgtaagtagagatgttgagtctggatatatgaatcttgtgttcaggggtaagatataaatttggaagtttatcagcttgtacatgaaacttaaagctttaaaagactggatgaggctgggtgcggtggttcacacctctaattcctgcactttgggaggccaagatgggcggatcactttgagctcaggaattcgagaccagcctgggcaacgtggggaaaccccatctctacaaaaaccaaaataattagccaggcatgctggtgcatggttgtagtcccagttactcaggagggtgaggctggaaaattgcttcaacccaggaggcagaggttgcattgagccataatcgcaccactgcacaccagcctgggcaacacagtgagaccctgtctcaaaaaaacaaaacaaaacaaaaaaacaggatgagatcaccaagggaaggtgaataggaaaagaggagtagtccagggaccaagcccttgaatcacttttttccttctaccctactttctatattggctgtcttgccaaaccaccaggtgagagggcattgggtcctagtggggttgagaatggggagtccagaacttcttggtcctgctgcagcctctgtgctcctgacatgtctccattcacttttttttataattaaaaaaactggccaggcacagtggctaatgcctataatctcagcacttggggaggccaaggtgggaggatcacttgaggccaggagtttgagagaagtctgggcaacacagcaaaaccttgtctttatgaaaaataataaaattagctgggtgtagtggtgtgcgcctgtagtcccagctacttgagaggtggaggtgggaggatcacttgagcccaggagttggcagatacagtaggctatgaatgtgccactgtactccagcctgggtgacagagctagaccctgtctcttaaaaaaaaaagagataaaattaatataacataaaattaaacattttggtttttaaagtttttttttagtctcactctgtcacccaggctgagtacaatggcacgatcctggctcactgcaacctccacctcccgcattcaagcaattctcatgcctctctacctcccgaatagctgggattacagacgtgtgctaccatgaccagctaattttttatattttagtagagatggtatttcgctatgttagccaggctgatctcgaactcctggcctcaagtgatctgcctgcctcggcctcccgaagtgctgggttactgcaaccagccaaaattcaccattttgaaatgtataactcagtagactttagtatattcagatgttttgcaaccattaccactaattccagaatattttcatcagccccagaaaaacccctgtactggatcaattcccatactttaataaagtttttctatgaactttattgaaatataatttacatgcaataaaattcatcagttttaagtgttataacttgatgagttatgacaaatgtatgtacttaggtagccaccaccacaatcaaaatatagaatatttccatcatctcctgaaatactcttacatttaaagatgtgaaaggcagcaaaggaaactgagaaagaggagccaggaatgcaggaagataaaaaggagactttgggctcttggaagccaacagaagaaagtatttcaaggatgaaggaatgaccaactgtgtcaaatgctaatgctattgtcaaataactaaggtgaagactgagaattcaccatagaattcagtaatatggaatcactggtgaccctgacaaaagcagcttcagtggaatggtaagggtgcaagctcaagtgaagtgggttcaagagggaatgggagaagaacatctggagacagcaagaacaactcctttaaaacaattttcctgtaaagggaaggaggggagggacagtgactggaggggtgtttgtatgctaaaagggctgatacagtacagagggaaaaagtgctgatgcacaaaagagcaggaggaagtgttgatcgtacacttaagttagcaagaaaggagatcaaatgtacaagaggagggattgtctttagacagaagtaggaactattcattcaaagtgtggaagagaaggtgaagagtaagggcacaacggatgcaggtacatggaagcttgtagaagctctcttctcattgtttctcttttcttgaaaattgggaagcaaggtctgatgatatcagctaagagtggggagagggaagtgcgtgttacaggtttgaggggagagatgtgaaaccgtcatccaggaggttgctaagcttgaatttaaagtaagatcagtcaacagaactgtttttttctccatcaaagttcagctgggcaggtgcaggcatgggagcagaatggagagagttggatttaaacactctgtaaaagcacagagtaagcagagtgaagagagaagcaagttgaagcaagttgagagagaaagttgaaggtgcagaaaagatggtgattataatgattaatcaaggactgaccttggagtttaagccagataggaatgaaatgaggtgtaaggagggagtgaagaacagaagaaaggtgggaggataaacaggtgagttcaactcaatggtactgatgatttcaaaggattgttggactagagagaggaagctggaaagagaggatggagggggtagcaaagaaagagatacttgaaattgagattatggggaatgagaggctgagctagggtataggacagaaccactagaagaaaagaagtcaaggatccaagaggccagattatgggaagaatcatctatgtggatatagcaatcaccaagaattatcacatgactattagtaatggacagagtggcaatgtgccaggaactaaaagatgcaaagaatgagagggagtgaccaaaggatcaggaaacacaaggagcagtatgggtatggcacagtctgatgacatgagattcaaagatgggattttttcagagagaagggagaggtgtctggaagcagcaatgaggatcaaggaggacaatattccccttccaggctcagtggttcaaaagaaagacagaaatcagtcagtacttcagagggctacgggggaagcaatatctttagaggagagacagatctcaaggtgaacaaggaggttggagcagaagatgaggaggtaagggattttgttgataattgaccgtaagtcctggaagccacaattaaataaagatatatatttttgatttagcatgtctcgcactaaatgcatacctactatttcatctagtgctcaaccaaagaaacagcaacctgttttatagatggaagaaaaaccaagtgaacatattgagaaataatttgtctttaatatggtgtcttaaggaattttcacaaataattttgtttatatttaatttttaccataagtggtgatttttgaacttaaacctctacccttcccccacctctccacacatgtagcataaccatatagcaccttgaagtagtatatgctcttagtgtgtaccttgtaaggatcctcaggatctacccaggccacatgaaacatatggcgaatttcttctgccagtccgattcttgctccactgttggctgatacatagatgcgtggaataccttctgccctagcaagttcggaagctctgagaaataacaaatcctcttgaggcccaaaggacccaattcggtatgtgatgtcattgccaataacaatgatatctcggccttctggatattcaggacttttaaaggtcattttccaagctaccatgccaatctggaaaggcataaacaaacaaatgaacagaagtttcttacaggcagaatttttttcaggttcattgaaggtatcagagtatacctaggcacagccattatgtaaagatacacattgctaaagagccaaactccctgtgggaaactacaaaagacattctagtatactgctagattatgctgagaacagctggtctactgtgtatttcaaaactgtctcaattccttctttgggcctgctcaaagaagacagaaaagccaaaatctaaatgcactcaggatacatgtggaagaatgccatggcactgttgattaaatctagatatctcattttactgccatatatactaagacactgatatggtttggatgtctgtcctctctaaatctcatgttgagatatgattcctaacattagaggtggggcctggtgtgaggtgtttgggtcatggggtggatccctcatgaatggcttggtgctcccctttgatctgagtttatgctagatctggttgtttgaaagagtgtggcctcttgtgggtgaaagcaagcatgaagagagtgctatgaacgccttgggcacactacaagagtacaaggtggtgggttgctgcctgcccacccccaaatgccacatgctgcccttctatggtatgcgaatcttgcacctaatcatgtcattgtcaagtcccgtctctggtacttggtatctcagctaaagaagataaggagtcttcagggaaaattgtctactgtaggtaggtgtttgagaaatcccccctgcaggtgaagaaatctggcatctagctgcactacgactcccgtagcagcacctacaacatgtactggatatcaggacttgaccaccatgggtgctgtcatccagtgctagtgagacatgggcacctggcatcacacacaggcccactccacccagatcatgaaggtggagactgcggccagcaagtgctgccagctggcggtcaaacagttccatgactccgagatcaagttcccactgccccatggggtcctgcatggttagcataagccatacttcaccaccaagagtcccaacaccttcttctaggtgcagggccctctcacccaggtgtggcttaaattaactcaaaaatgtcacggtgctaaaaaaaaaaaaaaaaaaaaaaaaaaaaaaaagagtgtagcactttgccccccacctctctcttgctccctctcacctctctcttgctccctctctcaccatgtcatgtgctgggtcccccttcaccttcctccaagatcataagcttcctgagacccttagcagaagcccaacagatgcagttgccatgcttatagagcctgcagaaccatgatccaaaaataaacatcttttctttataaattatccagcctcaggtattcctttatagcaacacaaatggactatcacagacactatttccatcttttgtgacatttgttccaagaaacctttaacacacaaggaagcagaaaaaggatgacgtctcacggactgtacacttttcatgatccaggctccttgtactgtcctctagcatttgataggaataacagaaacactctttactgatttgtttcaggtatgttccatttctgctagaatttaccaatgctcaacattgcatccttgtgagcatctcttgctttcttctagcaccagaaaaaccaaaggatggaaataactaatctcttgctgcactatatgtaaatctctgctctctgttcagcagcatctggccagctacacaaataaatgatattgacttaaaaggcagaggtgacatgtctcttcccaaactctcacagccctctcctgttttaatccccttctatatgagaactagtcaatccttctacttgtatatttgctagttccatttcttttctatgctattcattcatacgctagttacagctgtagtttttcatgtctgcctgcctgtttcccctatacctggataagtaatgttttccattctttttttccccctttctttctgtctctcacccccctccttgcccccaccactcgccaccaaacacaaagcctacctaccagatgagcttccctggtcctgcctaatggagccccagccacatctgcagccttggtccctcatccccaggctgctgcatatcacctcattggggagctggccatcaagaagggccattaacagatgtaaatagcggcatccctggaaagccacatgcatcacccagactcaaccaggccagtgatcataagctctgagtacacattcctcaatccaattgcacatccactgtaatcaggctggttgaagcattctacacagctatttgtgattctcagcattaggaaatatatatatgaaacaccctcagataaatataagctatttaatatatcataccattggccaaatacaagtcaaaatggatatgatacacagaaaaaaatccaatcactttctaagataaggtattactctatctactcattaaagacagagaaaggaaggaaaaatagatcattcaaaaaataacacagtgaacactcaaatatcaggataattttggttgtggtttctaagaagctagttaatataatccctgcatgaggagaaatgctttatctgccttcacacatgcccctctaaccccaaaccttttgtttttcaggaatgaaaagctattttctgtcaattttcctctaaatgcatttgtagttagaaagattgcgttttacaccaaattttatgatatattaaccctaggcacataggccagaagcagcttagatacaagccctgaagaatctacttcagcatttgtgtgctaatgtaaacattgcgaccatgtggcactgggcaggcaaataatactcttatctttcattactacctggggactctaactgtgtcacttgggcagcaagttcagcaattggctaggtcattatgcttgcaatattgacttctaattaggtgtcagcacagcagcaccaagaacacactattctttatcaatgtctttccaaagtatgttgctcatcgaccgcctccccaccccgccccgccccccatcttaaaaagtaccattacagaatggagagtgttatcccagtctcagtgcagcaagattcctgatcagaagacattcagttttgaggtagcatgatggacaaacatctaagaaagcactattattcaatttacattaaaataatttagatttcactgctaatcaaaggatagggcatataaaggtgaacatgggctttggagtccaacaaacttagatccaaatccaggcgctatcacttatattaactaactgtgtgatcttaagaaaattatttaattttactgagcttcaatgtccccacatgcgaaattaagaaaataatacccatgggtttgataaacacactattagaagcagaaatctactatattaacttctacgtaaaaaactttgtctttctctctcctctcctctcactctgtccaaatcttacccattccaaaaggttcatccaaattccatttcctcagtaaagcttctcccagcctaaagtaattcctatcttttctgatctcctactaagacctctgtgtagagaattttttttttttttttttgagacagagtctcgctctgtcacccaggctggagtgtagtggcacaatcttggctcactgcaaccttcaactcctgggctcaaggcaatcctcccatctcagcctcccaaataactgggactacaggcatgtgccaccatactcggccaatttttgcatttttttgtagagacaggattttaccatgttgcccaggctggtctcaaactcctggcctcaagccatcctcctgcctaggcctcccaaattactgggattataggcgtgagccaccttgcccagcctgagaattcttctgataactaattatatgctgcctaggattgcttttggcttaccatcttgaacgattatagcatctcctctagtgcttcccaggaacattaaacatagtctgggagtaataaatgtttgctagttccagagtctttttattttttcaatttaatttttttttttaagacagggtcttgctatgtcacctaggctggagtgcagtggcacaaatacagctcactgaagccttggcctcctgggcttaagtgattctcccattcagcctcctgtgtagctgggaccacaggcgtgtgtgttaccaccatgcccagctaattttttttattttttgtagagatggggtctcaccatcttgcccaggctggtcttgaactcctggactcaagtgatcctcctgtctcggcctcccaaaatgctgggattacaggtgtgagccactgcaccctgcctcacttttaaaaataacacttgaaaaatacttaacaccaagggcttagaacattgccacttatattttaggaatcatagaataagagtcctgaatattcttaaactattttattttaaaaataacaatagctatcataataactaccattaattgaacatttactatctgctgtactgttctaaaagttgacaactactgatagtggttaagagcttaagctgcaaagtcaagctgtcttggttcaaatctcagttttatgctagctgtataaccttggacacttaaccttttacagtttcacttttccaattataaaatggggatgacagcacctttctggaggtattgttgtgagcaacaccatgttaaactagtacagagcctggcacacaaaagccctcaaatggtagtcagtattaattcaaaggtagctgtaattattgccatgaggaaattaaggcacagaggaattaagtaacctgtccttatagctaatgtgaattgtttacttattttttttttgagatggagtcttgctccgtcacccaggctggagtgcagtagcgtgatctcgggtcactacaacctccacctcccgagttcaagcaattctcctgcctcagtttcctgagtagctgggattacaggtgcatgccaccaggcctggctaatttttgcatttttttttttttttttttttttggtacagatggggtttcaccatgttggccaggttggtctcgaactcctgaccttgtgatccgcccgccttggcctcccaaagtgcttattttttaaaaggagtttcacatacacaaaaatggtattttcttttttttttttttttttgagacagagtctcaggccattgcccaggctggagtacagtggcgtgatcttggcttgctgcaacctgtgcctaggttggagtgcagtgatgcaatcttggcttgctgcaacctccgcctctcaggttcaagtgattatcctgcctcagcctcccaagtaactaggattacaggcacgtaacaccacgcccggctaatttttgtatttttagtagagacgggatttcaccatgttggccaggctggtctcgaacccctgacctcaggtgatccacctgcctcggcctcccaaagtgctgggatagcaggcacgagccaccgcgcccagccaagaaatggcattttctttactagagaaattaaggaagtatgttccttaattaaaaagatattagtacaaaaactggcaaaaaaaaaaaaaaaaaagaggtctgtggtttatttaatacaattgtatcaatatttatttcttagtttggtaatcatatcatggttacataaagtgttttaacattaagagaagctgggaaagggtataccagaactctctaatatgatctttgtaactttcctgaaaatctaaaattattttggagggaagtaaattggatagtaagatcactgttagtgttctgtacagccttataagatgatgactatgaagactatgaatagcatttaaaaatacccatgatgtaatactaaattagaaaagggttcagactcaggagccacattctgagactctgaatctgaatctaagataatttgacagaactgagactcagctttctagccatatacgctaaggtaagttatcaacctccctgtacctcagttccttcactggtaaaacaagggtaataaaaatctacggcataagtttgttgtaaggattaaatacatgttaagtcctaggatagtgcctggtatatagtaagtgcatagtatgaatgacaacttcatcaattgaaaagcactttgcggggtaaaaacaaaaataaataagaaacagcaaaatgaggtgataattattgggatgatgaaattgtattttttttccattctccaaattttcttttttgtgtttatattgcattgataactttaactttttataaaataaaaaataactgagaaaagaaaactaccaaatactcttcactgggtgataggtacatgggagtttatattatttatgcctactttagtgtacgtttgagcatttccataacaaaaaaaaaaatttaaggggggaaaaaaatctcaccagcctaattgatttcccatattttagaggaactaattctagattttagtcatactacaaccgatcttatttatataaaatttgaaagagataaatgtatgaaaattaaaaatcaagactcactttaaagagaaagaaatatcaagaactacgttagtttgttgggttatcatttcattttctaaaaagaaatgctctgcaatgatgtggtagagtgtaaacatatgtatatataggtttatacaatattaatgtctctacctcagaagtaactgcttcagtgtttttctggtctgatggttaaatacatatttatatttttaaagtcaatatttgtacaatagacaagaacagtgcctatcagctaaatacatatttaggactgtaccacatgtattacaaacatgtactaaaatcgaaagcttttatttatacagaacctttcatcttgaagagggctaaagaactttacaaacatatgtacataaaaggacgtttgcactgataggcagggaaggtactcattcacccactcccctatttcttctaccagtcctgggtaggaacacatggtgtcaacagatgcaggtctgtaacagctgcaaagacatacaacacaataatccagttgtgatgcacagtcactgagaggaagcttgcaacttgagaatagcaacagctctcctccagtgtagaagcaccatagccatttccagctttgtgtttttaaattattctctacccaactcaactaatcacctgacaaaattgaatttgatactggaaatggtttctgaatgcaaaatactttctgtctgatgatgaaaactagattgaaaaatgcttccctctgcccttgttagatttaggaaaaataaaaaagggttacaacattcaggagaaatggttcaaaatattctacctaagaatagcttcatctcaaaggattagatcattgctttggaagagagtcatatttcactctctaattagtacactgttaagtttttcagtcaaattactttctatagatgggtctatctatattatatacataatggagatttcatatcgaaaattctacaatcactataaaagtatacacagtgtgacaatgtgattagcaatgtgacattcattgatttcacctaagcccaatctgcatgtatattaattgaagaataatgactaacggagaccccatcattaaatccctctttttgggggtcttctctttctctccaacatttttatccaggtgaaacccagtgaaaatgacatgccaggactaagagctgaaggaagatggaagagctaagaaattaacaaaaaggtaccctgtagcccgcatgtaagtgggtgggtttatggtctaatgagttttagactcaaacgggcagtgccagtgtcgtcttctctgatcactgcctctctcatgcactgactaaacaagtggtcctaggtacttactacaaattattttgtcattactatagccatgaataagttttaaaatatttaatttcagatcatttttcataacagaacattccaacgagcaggtttattaggtttagggttatcaacctaagctgattatcttaaagtgaaaaagggaagaggatgaaaagagccacagtgaataagctaaggataagcagaaataaatatttgtttcccttatacaagttctaaggcagaacatatttctttggctacattctgattctggaatgaacagctcaagtgagggaggaggggatgggaaggagaaagcaagcagaagagaacagtcttatttaactgtttttatgtgggtaaaatgatttgtgccacagtatttccataagaagtgggaccattattttcctgtagaaacacatttggtttgaaaagtatcactggacaggacgtgaaaatcaaaccaaatgaattattcacaacctccgatcagaggtgatcattatttctgatgctccaaacagtgattaggattctgccctgagatgtcattttctcgctgagtaacaccagcgatacagaaaggcattatctatctatccatatatgtattttttctgctgggaggaccttggtttaatgttactataacagatagtgaaaacatgataatattaacatttattctgatggtgcccataaatgccattagtctgacacaaagtgtcaacactaatcatgacccaaaattaacaccaaaattgacatcaacattaattgtactatcaatgtgaatagaatgtgcaagcacacacaggcacttcccaaagctgctgttgttactacaaaataaaacaacaatattaagctcaacaaagaaatttgcaggaaaagctaagggcaaaacatgccaggattttgttttttaagggtgaaagacatatccatcaactctagctatgctgtgggaagcagaaagagaatatctttgccacagctgcctttcttacatctccacactttgacttgagctctaacaatacctttccatacagatttaaatacaggttaggctgtggctgagatgttgaagctgtattcgttatattcatgctaaaagccttgctatattcatgctaaaatgatcttgagttttttttggaagagtctgtaaaacctattgttctaattctgctaatgccaggaagatgactaccctgcaaggcccttgagcagcaatacaaagaatccaagcatgttagcgctaacccagacttgggcatcatctgcatcataaagatgagaaaactaagatccagagagcaggaatctgaacttgagtcccttctcagatatataacaaaatgttacctctttcccccttttgtatcttgtatccaagcatgaaaaaaagagtttttcagctcttaagaaaattattttgagctccttcacatgatcacagaacactaaataatagaacattgatatctggcaaataatacaatatggaaaggcattgacatatttttcagcatggcttttccaaatggcacaaattaagtcaaatattgtattttaagccttatggcttacttcaaaaatggctgaacaaactcacctcaacctctctaaacagcgataaaagggtaagaaaaatataacttttagagcaaaaaattttcatcccagaggtaattctttgaaaatgttatcaaagattagaaataacaattttgaacagggaaattatttctccctgtaacatttatatacatgaaaccacagtaattttacacatgtacacacagtaatttaataagcataggaattattttttaacaaacatgcagtggagcacatagaagccagcggtatttgagaaatggggcccaggattaattggttggtatggaaattaaccaagttggcctactatagtcccagaagccttgtccattaatcatacgaatgagtgctgaactctggtgccccccgctactcctcattctctggtgtcatctgttgctgtcctgatgttcattattgcctctggttggagctgtaaagtttcttgacatagggtactatgtcacattctttttcagtaaaatcttacaacttaagacaggtataaatatgctggcaagtacattcttttgtttgaaggctatctctagacttatttttgaaagaaactgaggagccctccacaagtactactttagtgagccagtggatgcattaggattttcaaagtcaatcaaggttactgagcctcattttgctatcaaaaaaatgagtaaaaactactcaacctgatgagaaatctccaacaccaataatagtcattcagaaggaattctgagaaaagtatatacatcccaaaagaacagtgtcagaaattcattagaagtaattccatggtaggaagacttatttttcaaaattagcctccatatttttctaatgagggatccaagtttggtttggaagatcattttagacaaagacttgcagccaaatatacttacttagaatgggaataaaagaacaaaaacatagaattaacataaaattatcttaccatatatgccataatatatctttctctatacttaatctcaaggattcaaaattgatttttcaaagccttgatgaaaaataaggcaagcacaaattatgaatacttatgtataatcataatcatttatggataatcataattatacataatcatatgtatttgacccttttctgctgaggatcccaaagcacttataaacattctcctatctttagggacagattaatggcaaagaccctttttataagttgaacaatcaatgcatagaccatggtcctgttttacagacccgcttcgcttaggtctatttcagaactcaccttcagcatagtacaatttaaatatgcctcttttctaacacatatctaaaagactgacactgactcaatttctatacacagcatgaaaaggcaaactgatttcaaaagaatgaaacaaaagcaaggtaaagtacatccaaattagcatcacattcatggagctattttgaggttaaattgagtaaaacaatttaaaaaatctaatgttaaatatttgggtcctgtgttcatgagaaatggcctacccttttctcaccaccaaaacccgtaagcatatacacactctctacaggcagagttttagaacataatgctttccactagaatctgagtccaggataacccaagcaattcctttgagggtatggaaaatgtcaaccaagtgaattaagacagagggttatggtggtttttctaaaataagaggtcctttgggttaagaggtccagcctaagaactgtcaaaatggatctactaattaatttcttctaatcttttaggcttatataagcttaccaacttcctttccctaccaactcctaaattgtttttttgatactcaaattagagattcaaaggattatagtaacatgtaagtgaggagcccagtcaaaatggtaagatttgtttaagctggtcagtagatgcaggggtatttgtcatatcactgtgtatttttttatatgtttaaaataaaaaaattaatgagatgctatactttgggagacataggatatcagtacattgccaacaattaaaacaataattaaatatgggtattagttgggctagcagttctaaaactgaacccctaatccccactgtccctaccatttcacccctgagaacataaagcaggactaaaaccaaaataccagtcatgatggcagctagtctttttttttttcagccagagtctcactctgtcgcccaggctggagtgcagtcgtgcgatcttggctcgctgcatcctccacctcctgggctcaagagattcctgtgcctcagtctcctgagtagctgggattacaggcgcctgccaacacgcctggctaatttatatatatatatatatatatatatatatatatatatatatatttttttttttttttttttttttttttttttttgtagagatagggttttgccatgttggccaggctggtctcaaactcctggcgtcaagtgatccgccgaccttggtctcccaaagtgttgggattacaggcatgcgccaccgcgcctggctgtcagctagtctttaaactttaatttacactactttatttcctcttcaatcatcctcttctttaaaaaaaaaaaatagatccctaatgcaaggttcaaaggatcttcaaccaaagagttaaaattgcaattgcttattgcaggaacactaggtaaaggctactataccaactgaaaaaagaaggacaccagtgaatctgcctcaacaaacaaggccactcacaaggctcatgtgaatgctaagctgctgagaaggaaaaaccctgacacctagcgcccatctgaaaaaatgaaggctcagagctaccacaattcttaagagtggtagtgtgtgtagaggtgaccatcaaattgcattcaatttttttttctttttctttttctttttttttgagacggagtctcactctgtaaccaggcttgagtgcagtggcgcgatctcggctcactgcaacctctgcctcccgggttcaagcgattctcctgcctcagcctgccaagtagctgggactacaggcacccgccaccacgcctggctaatttttgtatttttagtagagacagggtttcaccatgtgggccaggatggtctcgatctcttgacctcatgatctgcccgcctcagcctcccaaagtgctgggactacaggtatgagccaccacgcctggccccagttgcattcaattttcaatatactttcctcccagaaaaacttttataccaagaattccagtctctgaataccaaccccttttttggatatacatcttgtacctaattattataactgcttccaaatacaacatcgcaacatcgtcttctcatctcagtttctcattatgacaggcatgatgagacagaatgttaaaaagctgcccatgttctgatatagtaagaaaaacagggtcctaatttctactagcactaaagttactatggtagttgactctctaacatatctttcagcattgcccactttagagattactggtctagttcgcagagctgataaaaagaaataaaataaaagaatgctagtaacttatttcagaataaacaagagcatagtctcaagaaggctaggattttctttgtcctaccaggcaaagttaagttgttctctgtcaagtccgttacagcccttggcttgatcttagcctgagctttttaataacaggatttagtgcgaaaagcagctgtactggattgcgaactgttactcaaaatgtccccacctgcaattatagcttccaccaaaagatcaaaacaggttagtaaactggcaggaaaatgaaaacaattcctccaaaattgagaagtggtaaagtagaactgttggatagctgcatttcttctgtatccaggctcaacagcacacattcatctagctgtgtatttacatacagtgcccatcactgtaccaacacagcagctagaaatgagatccgtttagtctatgctgcaatcacattttcctcaattttcatctttacttgaaactattaagaaaaatcttggacaactcatctttggagctatctgcaagtaacgtagttcacagatttagtctacatcttttttattcctactctaaagtcatactaaatgtaatgccattcaaatatgacaatgagaaaaatgtgttctcctatacctttcatcatgcattaggtggtactcctttagttacatctttctttatggggaagggacaactaggaaaatagaaaggagacagtagctaatacagcatcagaaaagctctgtctcctgctctaaacacaggcataaatgttcaaaatgcaggtcacatctctactgaaacagccaatattcctcctcaaatggcaaagaagttacctaaaactaaatggaactgaattggtccaagtcctggtcccatcacctttttacctatttactgtcctggaaaaaaaaattagaaagactggccacccatacagccaatggtctgataagtgcaggttttctgccttcgatcatggagaaaagcacctcaattcatgggaaaactctgaaggaatctctcattttacccttactccttacatccatgtgctagttttcaaactcagaaactccaatccttgaaggtaatgcaataccacccacaatgatgacctggtagagccgtcacttttggagaacaccacattatgatgatttaatgtctacatagcaccaatgcatttacattgagccttggctttcagaacattaacaggtcaattttttattcttttgtaataaaactatttctcaaggctctgtccagatgcccattctctttgggacaggacagatttactccaaatctcatcagcatgagctctgttcattcccttcacatcattcttggggtaatatgtagagtgccaggctcatgacaaacttgctctttggccaaagaaaattaaaccgcaatagctgaaagtcaacttgccctgataaaactgggctcagcacgaggaaatacatcctactgacactttgtcatctcttaggcacagctgtccctcagagttctgactgctgaaactccatccttagattggtcagtctctcagtggacatgctccattgtatgttcaagctattggtagcagagtttgatactaacaccccaacctcattcctgttgtgcagtgccctataatctagctaaggccaatgactgacttcaccagccatcctgggcattagtcactaactgctcacaaaagaacatcagtctaactcctcccaagctcaaaggctcagaaacagcaagctaacactcagcctcaatcctagtcaatcatttgaaaagaaaaacagaacaaagaaaataggcaactaaggagggaaaactgtagaacaagaagaaagtgagaactgacaaaaactcaaaatcttttgaagaaatactattcactttctggtttcaaaactattaaagcactggacaaaggaaaacatgtggctcctatactagatctactactagtcatagctatagtcctatgcaactgtttaagacatatcttttccactaaggtttgttaggtcttaaaggggttaaaaaaaacctttaatttttaaaaaattcgtgtgtgtgtgtgtgtgtgtgtgtgtgtggtctttgggtacagaggcccgtataataagactatttgtattcatactggcagagtaaacactacatgttcatgcccaggcagctctgtgcttgtaatttcagcaagaacagagctctgtccctctgggacttcactattccctgagtctccattcgctcaaacacagaatgagggcagaaagaaagcaggaaagaaagatcatggcaaggggtttcacacagcactgcagctagctttcacgtggccaaaaatctcattttgtgttttaattacattagttaaaaccattttgctctcagccccatgttcacaagggtgccttccattcctgaagactacactgttcaatgaatcagaatttaagtctagcacaatgaagcttttctttgctgctgaggggctcactaggcagatgctacatacagtggcagaaacctctgtttcaacttcgtgtgctgatgagtatatatctatgcttgtcaaaatgttttgcatccttccaccccagtcctcttgactttgctatttgttgagactcctacaagtctgatactctccatctggtccaatgcttgcatccatcttgataccaaatcatctactgttggcatccactggcatattactgaaatagccacacaccttgtatatatagtgaaattttttgaaaaagattgagcaaaatagaaacaaactgcttattatttccaaaggtctacccagcctatttgtggtgaaaacacaggtaaagattactccttcaatggaatgaaatctttctagggattatatttaaggttgaaataaaaatatctctctttttaggtttgttactggtattatcattgttataactgtacattaggagcacagttaaaatcagaaagaatcataatgcatggacaagagtataagagtatagggcaaaataggactttatatcactattcataggttactctgagagaaaggatgccaaggctagaaaatgcattcttgggataattatcaaaaaatgggttctttgctacattttttatgtttgaacccctaattctgattgagccccttcaagaacacatttatcatgctcacaacagcaccagatcaaatgaattgagcatggaaaagacactgaaaaatgcatttattaatatgaatccaaataagaaaaaacattaagcaaaacaatactttaaatgttttcattatagaaaatcctggctgggcacaatggtgcacacctaaaatcccagcacttttcggggctgaggcaggcagattgcttgagctcaggagcttgagaccaacatggtgaaaccccatctcaagaaaaaaatacaaaaattagccaagtgtagtggtgcacacctgtagtaccagctactcaggaggctgaggtgagaggatcacttgagacatggaggtcaaggctgcagtgagctgagattgagccactgcactccagcctgtgtgacagagcgagacaccatctcaaaaaaagaaaaaagaaaaaaagaaaatccccaaatttcacacatagacaaaaacagggaaaataatctattttcatgtacctatcacctagcttcaatgatcaactcacgaccaaccctgtttcatctacacacccaccctcacacctctttatttagaagcaaatcattgcatctgtaaatgtcttagtctgtatctctaaaagaaaacaatattcctttttatttttttaaaactgagtcctttgtgttaaaacaatactattttaaaaagcaaaatcataataccattatcacacctaaaaaattaataatttcttgatactcagtcaatgctctctctaaagaactctcccaacaagactaccatgctccagtgctatttaatgaccacctcacagaaagctggtactagtgggcacagagataagaaagggaaggggggtttcaactacttgcctcatttcctcctggaagcctgttcatgtggaccagctgaccttgatcatccagtaccagttcagtgtaagtcagcatgtcagaaggcagagggggagatggaagaaatgcttgagtggacatagactcccagagtttgatcagggactagtggagaaaagaagtttgactaatcagtcacaataatttcaatatagacaaaaataattattaagattcagtcaatctggttttgccttcttttccaagtgttctgcagagtgtaaacattagactaaattctccagctcccattctcagttaaaatagatttgtaattactttttacatgccaaaagtcaggcacttttccaaaaagtcaaactactgagtgattccaaatcagcaccagagcattaacaaacaggaaagacctaacactatcctaggaatattaaaattaaaaaactaaataagtagcatcgactccttaaaacaaagaaaaggaaaatcctaaagaaacttgacaacaaaggaatatccaggaaaatgacatgacgctcagctaataaaaagaaaatccaagaaggccagaatgaagcttctactagaaattccagggaagaaacctctttctaatatttttcatagctataggaccatacacaggaattagctcactagatgtgtgtgactatttgtaaatgtgcagatcaattctgctcaattttgacacagacataccaattcatttaaaaaatattatgatttccatttccaacttcctgtaagtaaatcctttgtgaagtgggagctaattcagctctttctttgcttgcctcaaagcaacatttgaatcccaagtgactcatacatacctatgtgtcctaatcactgtgtttatgcctattatataggaagaattacttagaatgtgatttatattatatttatatagaatgtgatttatattatatttatagcactggcattgggaaacagaagtaacactcagcttttaggctagcaatgctataaaagggaaataccgaatgaaggtatctttcaggagacagaacttgtaaacaaatggttgcataaaggtaatctcttgtatttgtgaataacacaggaattctacacagactatttactacgactacatatattactttactaaaattcaaatgtggtaatactggtagtattgactaggagacttggaaaaatcctatattcatagatttttttaaaaaggacaaattcagtattcttttgataccttattctttactggttgcattttctactggtgatacacttttcttgccttctattgatagaagaaaaatctgcagcatagagatgattcaccatacagattgaaagaatttgttttcatatagaggctgagattcataatgtcatattttctcatgctagtttttattcagctataacaaatctcccacaaaagaacttatactctaaactgtgtaccatgaactctatatccatttgtctatgctatctatattgattctcatcatattaatctagggtatcaactaggaaccaggtttatattggaaaatgagaactaaagtatcagatctcctttttaatatccataatttgaatatagacttgggaaatacacaggtaactcttcacacaagtcactgtaaactatcaccacaagaacataaccttagtttactctctcctgtctcctactcaatagagacttctattctcaccattcctctcattaattcataaagaaccatccaatatctgagttggcagtcaccaatcctcaaatgaaatagaaatgaaaacagtgtcaagatatttcttgccctttggagtgcccccttctagccaaaaccgcatctgatggaaattcagggaaaccttgcctccttagaacatgtcagaccctccagttaggcatcttacctgccgaaacatctctgggatatcatatatgtatgttgtccctaaggattgtgcctggaacctctttgattgcagcaggtctttggtcacatatggagtattgattaacattccatgcagtggtccctgtttgtctccatatgcctgaaacatgatctgcaggaaaaaaaaatggcatggggagttaagagacagaaaaaaatcagagagctgcctagaggggctttttttgcacaaatattatctctttgaaaacatttttggtaggttgagtagctgagatatgcctcttaacactgggtacttggtgctctcacctctccacagattaaccaactccaaaaaatatatatatataaccagccatataccataactgctctcacttttagattagttgaaatcaacaagaaagaaggccaggcgcagtggctcacgcctgtaatcccagcactttgggaggccaaggcgggaggatcatgaggtcaggagatcgagaccatcctggctaacatggtgaaaccttgtctctactgaaaatacaaaaacattagctgggcgtggtggtgggcacctgtagtcccagctactcgggaggctgaggcaggagaatggcgtgaacccaggaggtggagcttgcagtgagccaagattgcgccactgcactccagcctgggcgacagagcaagactctgtatccaaaaaaaaaaaaaaaaaaaaaaaaaaaaaggaaataaacaagaaagcacggtgcacatttcgcatctcaaagacagactgaccatgctagccatctaaagtgagttgaatctcatatactcagaaatgaagtacatcaactaaccagtctgagcagccctggtattgaagttgaagaacagctatgcagtaaagataattctcttctttcctcaatggcagaaggccagatcaagactctagtatatcatctgtgctttagtcctttaacccacttgattagatggtacttcataagtattactagctatgcaaaggcttcaaagatttctgccagaagtggatttcatccatccatctagatagttaattctcactagcccatgagacacagcctcatattttacatatagtaaaataaccatattatattaaattatgtatattaaaaaacatatatatatatatacatgtatttacttctcctcaagatgctgtctacaactagtgaatagctcctgcaatacctatattgtcacataatgaaatcactacactggtttttaatcattttaactcaaatatttctagaggagtgcttcatactccatatatttagatagttttatttgcttatgaatatttataaaggatgccattatttcaattcaattaatatttattgagtgcccagaggttgtataacactaaactaggcacttcatgcatggatacataaaatataaattcccagtgcagtgaatacaaatggagattgggatgtaagggtatgtgtatacctacatatctattcagacctacaaaataagcacaagtctaccattaatgaatagattgtggacctgatatatatgcacaggaatagaattaagtaccttcctaaatcgtgggtacagttcatctgtaaatccttagccccttagctcagaggaatgaatgttctgctaatttgtcaatcaggtcctgttctggggaaaacatgtctcaggctgttttaaagacccagagattggagctcccagtcctcttccacaagatcaataggaaaagtcacccggggggaagcagaattagtaatgtcttaggaatgtgtcagtaaaagcaataatgttttaagagattcaaagtgttaagtaaggcaagggtacagtatgagaaaactgtactcagagcaagtaagctgaatcaaaataagaaaatggggtaaacgcagcaggttcctagaactacatttctcgtctgttaagagagacaagaccttgagactcggtttggccaagctttgtgatgaagacaggctggtcatagttaagcaacataattgtgcactgaggaaggggattggagaaaacaatctagctacatatgtatattgctggcagaaatttaaatggtacaaatattttggcagtttgtcaatatcttataaagttaagcatatgcttactgtgtcccagcaattacacttttacgtatttacccaaaggaaataaaaatatatctacacaaagatttgtaaatgaatgttcacagcagctttattactactaatagctcaaactaggaaataaaaccccaaatgtccatcaacaggttatcttggaaaattagacaatgagaactagagggccgggcgcagtggctcacgcctgcaatcccagcactttgggaggccaaagcaggcagatcacgaggtcaggagatcgagaccatcctggctaacacggtgaaaccccgtctctactaaaaatacaaaaaaaaggctgaggcaggagaatggtgtgaacccaggaggtagaacttgcagtgttgcagtgagccgagatcgtgctactgcactccagcctgggcgtcagagtgagactccatctcaaaaggaaaaaaaaaaaagaaagaaagaaaagaaaatgagaactagagtttcagtccttttttttttttttttttttggagacggagtttcactcttgttgcccaggctggagtgcaatggtgcgatctcggctcaccacaacctctgcctcctgggttcaagtaattctcctgtctcagcctcccgagtagctgggattacaggcatgcgccaccacgcccagctaattttgtatttttagtagagatggagtttctccatattggtcagactggtctcaaactcctaacctcagctgatttgcccacctcggcctcccaaagtgctgggattacaggtgtgagccaccatgcccagccagtcttttttaatatccataatttgaatatggacttaggaaatatacatgtaactcctcacacaaatcgttgtaaactatcatcacaagcatgtggtcttagtttactctctcctactcaatagagacttctattctcatcattcctcccattaattcataaagaaccatctaatatctgagttggcagtcacccatccccaaatgaaatagaaatgaaaacagtgtcaagatattgcctgccctttgggggtgccccttgctagtcaaagctatatctgatggaaactctggaaagccttgtttccttggaacatgtcagagctcccagttagtcaccttacctgccaaaacatatctgtgaatataaacattttgataaatgaatgtaaaaatttcgataaatccattaaatggggctgggcatggcagcttacacctgtaatcccagcactttgggaggccaaggtgggagggtcccatgaatccaggagtttgagacaagcctgggcaacattgtgggaccctgtctctaaaaaaatttaaaaactagctgggcatggtggtagacgcctttagtcccagctacttaggaggctgaggtggaaggactgcttgagccaaggaggtcgaggctgtggtcagctatgattacaatattgcactctagcttgggcaagatagtgagaccctgtctcaaaaaaaaaaaaaaaaatccatgaaacggaatactatccaaaaatgaaaaggaacatacacataatctatgcaacatggctgaacctcaaaaacattatgctgagtaaaataagctagacacaaaatagtacacactgtttgatttaaattctaggataggcaaaactaatctatagtaacagaaagcagatcagtggttgcctaaggccggggttggtgcttctacctttgactgcaaaggcgaataagagaactttctgcagtgatgtatctaccacaactgtgatagtacttacacggtgtatacatttgacagaatgaattgaactgcacacacaaaacgagtccattttattataagtaaattgcacttcaataaaggtgttatttattatttttagaggcagtgtctcactctctcgcccaggctggagtgtggtgtcacaatcatagctcattgcagcctcaaactctggggcccaagtgatacttctgcctcagcctcctgagtagttggtactacaggtgcatgacaccatgcctggctatttctttttttttttttttttttttttttttttggtagagacagggtcttgccttgttgagctggctagtgtcaaactcctgggctcatgtgatcctcccaccttggtctcccaaagtgctgggattacaggtatgagccaccatgcccagcccaaagatgattttaaaatgttatttttcttttttttgagacggattcttgctccattgcccaggttagagcacagtggcacgatctcagctcactacaacctccgcctcccgggttctagcaattctcctgtctcagcctcctgagtagctgggactacaggcccctgccaccactcccggctaatttttgtatttttagtagagacaggctttcaccttgttggtcaggctggtctcgaactcctgacctcaggtgatccatctgccttggcctcccaaagtgctgggattacaggcgtgagtcactgcgcccagcctaaaatgttatttttctcttacactgcacattggaaatcaattcacttatgcaatggattacccaaatctcttctccccattatgactgcctgacatcagtgttcattacagcctatactacaaagactgtacaaggaaaatgaaaaataaaactcaagccaatcaaccttgttccttattggcagaatgaataaatgatgtgctagggcaagaggctgatagtaataggagttcctgaatactcaactatctatgttagttccattttctactataatgaacgcagtaactaaaaactgtaaagtatgttttagaagttcatgaaaatatgtacacattttatatatcacacacctttcaccagaagccatcaaaattattttagaaaataatttctgacccatagtctgctcccttagaacactgtatttatttataatagcacatatttgccacagagaaacaaatcatttgtcttcttccattgtgatgtaaatttcttgagtacagtttgctttttctctttatacgcatagtgcctgacatactataagtagtcaatcaatattaaattaaaaaacaaatgaacgaataacagacatggttctgtattaacttcatacaatgattcattaaagaaagggaaaaacagtttgacaataagcaccatgtaggcattaggagcaccagaactgggttggaggctgctccttttgtcagttcccacgtctagccacaggctcaaaagttagttcccatatggcagtagctcttgaactctctcaagtgaagagtctgtagaagacctcttccttcagggcttttaaaatatgcaggaccctaggtaaaaagcgttttccttcaggctgaaggtggtttgttcattctttcagatgcttattgtgtgcttattttgtaccatgtgtaatactaaaccctgattgaaggcatctgtgcctttcacactcctgtgtcaccattagctagcatgagggaaatctcagagtttcctaataaaggaaaggaaaaaaaaaaaaagaaagaaagtagttatgaagaacaaacatatttatcaaaaacattaaaatctcaagtggccatcttacttttcacaagaatagacctgccttgaagctattgtagaagttaattaaaaacatccctacccattgaaagctttgactgaaaatgtctttaaagttgcactaaaaaaacatcaaatacagcaaaaaatattgaacactctttctcttggtcaccactcacgctcttgcgcactctctctctctgtttttaactgctcacttctcataggatagatttctctagccacctcactaggaatcaaagcacaaaatgaaaggtcattctgactactgtccaaactgagatttttaaaaattcatcttcaaaagactgaaaaatatattttcctgactctattcctggatttaaaaggatatagataaaaacaagagacacataatctctccctggcacccaaagcacggaatagactgaaacccttgtttatgtatactggagcaggttcatcctttaatcagaagaaatgcaattcttgaattcaggccaaagccataaaatatcctagttcttcaaaaatgtgaacaatggtgaaccaacctaatttcagtatcatagtaaagagcccaaatatttagaaaccaacgtagtaaaaaagattaaaagggaattctctgtttcacagaattagtgtactgactcactttctatttttacattctcagttttcctacctgaaaacgggtttaaatttgccactttgctcttgtataatatatgacaccctgaaatctttgaaggaaagggaacaacataatagataacacaataaatatgataaaaacagaaacagaacacaatagataaatatgatagacactgatgatggtagtgctcatgccactatactatgttgaaattttccttctttaacatagaagttggtgacataaatccaacaattctcttttcctcacttgccaatgagtagtttaattatggtgaaaacggaaaggacgcatcagaccagagattagattgctgaaataacccacgagccctctaaaaaaagagcctaaattgcagaataacctctggagtcaggttcacttggcatctgttagtgcttaccaatacatgacaaatggttaagggttttataacatccatgatagagaacataggcaaatcttataaggcagatgaagtttttcaaattcatacaatcatttaatcttatagaggataatcccaccaggtgaaccaatgggatttgtgagtgtgggtcttctataacaaggacgagtgtcttatctgtaggaccaaatcaaaactctgaggagcctgtttgagtattgtacctgtgctgtcctggagtcagtcacttccttgtataggctgatatccaagtaatagccagactcgtttgtcaggaagaggcggatgggaattgcttttccagttggcgtcaggcgaatgttgattttcagttctgcctggaggacgcgcaatttccacaggcgacttccataccgcattaccatgctccgcacggattcctcaatctgacacagacacatcaccaagcacaaaacttaaatatcttctaactaagacctgtttcaggtctgctcatatttgagaaagaaggggtaaaaaaaaaaagaggttggtttgtggagatgcacaccttacaaaaagtggtcagatagtttctccccaaactattctttcttggaacaagtcagggacaatttcatgctggcctggcatttgagtggttttctctcgataataacacccaaatctctgcaactccttcccctttcccaattatattcatattctatatcaaagatctgcagtatctaaaattacaagccatgggatttaagaggaagccccaaataagaataaaatctctagttaaatagctattaagtagcatttatatgcatggtaactatgtttcactgcacttacaggactttaaatcaacacagcaattaccaccatgagctttttttcatacagttttattaaactttataatatatgtctcttggtaaattgcacaaattaaagaaaggcaatttgtaggtggtgctagaacattctctctaaacagagctctgaagcttggccactgctaagtccacctaggatttaataagatggggcagatgttcccacatttctctaagtttataccaaggcagcttaatgctcttagtttttaggggtaggacagttattttaactaaatggccttagacatgatttcttgttatttacatgctaaagcaaaactttttttccccaacatggctgcacagaacataatgcagctagaacatgctattcgaacttaatgtatccttaaatgaagtatctttctaaaatgcttcctcaacttcttagaaaatctcaagaatatcttacattccctttctcttgtggttctttagtagcatgtgccacccttgcagtttgtttctgcaccacaaaattttaagttagaatgaatttcagggagttaacctctctattatcatacttgcttgttaaccaagagatatttacccattcttttcttgagggaacaaaagccaacaatctttatgtacagaaaattggcagctatctatcattagaaaagcagagccagtgtatatgggtggttagaatgaaagcagaggctgatctgaaaaactcagagaaaaggtaagccaaatctaaaaaaaaatacagctgtacagtgtccatgccatgttttaagtttcccagcttattagtcccagaatgcttaggagaagttttgcttaaactagatgatgagatttgagtcaaatgagtagccctgtccttggcgttccttacaaactaaagcaacccatcattagcttggaatttttaagggaaaaaggtagaaaactacttctcagatctcagatactaagttcaagaagcaaaagtctaccaggcatgatgactcatgcctgtaatcccagcactttgggagtctgaggcaggaggatcgcttgaggccaggagttcaagactagcctgggcaacatagcaagaccctgtttctgtaagaaaaaaaagaaaaagaaaaaaaaaaaaagcagcagcagcagcaaaaattcatgcctacagctgatcttgaaaaagggagatactggttctcctatccaaattccacagtatcatgatagaaagagttagaaggggccaggcacggtggctcacacctgtaatcccagcactttgggaggctgaggcaggcagattacttgaggtcaggagttggagaccagcctgactaacatggtgaaaccccgtttctactaaaaatacaaaaattagccgggcgtggtggcacatgcctatagtccctgctactcggggaggctgaagcatgacagtctcttgaacctgggaggtggaggttgcaatgagctgagatggtgccactgcttcagcctgggcaacagagcaagactctgtctcaacaaaaaaaaaaagaaagaaagaaagcgttagagggagcagaaacagagagcagcctgtctttattacacttgggataaaaggtcaagtacaaaatcaccttgtttttcttccttaaattatatagaatgcatttcagaatagaacctcagggaagaaaatatacataatacatgagaaattccttatcagccaaattctctccctgtggaaaaacactaaagagagataggttagacactttgagaaggtgcattatctcactaaggccaccaggtgattaacatttagtgcacagaagcagtaatttagccaaaatgcttagtaacagtaaaattaataattccagatgagaaatagtagggaataatacaaaacaggaccactattatggcaaatataaaataggtaccaacaaaagaaaatgttttcacgtttttgtactgcttataagtgaccagcaagctaacaccaaaaccttcagttttgagaactgttttttcaatggctatatcaaatttttgacactgtcccagaaactcaatcttataaacattctataaactttacagattaagggctcaacagcctgaacaaggagtacctgtttccaagtccaagtgagataaatatgaatgaacttctgtgcttatgcttgctagtgctgggagagaagctaaggagaaatgtacctttgatgggtccatgataaccgtgggcacaaagttgaggaagatgtggttacagtcagtgcggacatttgtattgttaaaagcaacttccaactcatccatggcttccaggagtagccgctccccttcattttgcagatattcaaaagaagcttcctatacaggaagaaaataatcaacattaatgtagtttaaaagaggcaataaagaaatggctattataatcacttaagcagcagtatatcatgaatcataaggcacttggtgaagagattgtttatctttctccctagagtcagtccagtaaccacagggagcaggggcaggaaagggccagataaagagtccatgtcagcccttcctccttacttttagtgcatcattcccttccaagaggtagaaatactgggcatccccatagctgtaagttcaataggatgatatttcacatatgccaaacagagctatttagaaaggaaaagctgaagaaagggtacggctatgggatataataataatgaacacatcaggaagtgccttgctatatacagacactacccatacttctagacaggtgtacaatgggatcacctctttcctaacttatctccttatgctctaccatcacccaattcttcctgtgatttttctgtttgtatgctttttcttttcttgagtgttattatgcttctgctaccaagaaaaatcaaattaaagtggaaaaagagccttcattttttattttttttcagatgcactttctgctttgtaaaaaaaaaaaagcctttattatatgaaatatttacttttgtaaacattgaaatagaacaagaaccttgattcaaaaaatgaaaacctgatcttttttttatgttctctctcagcagaagcataatacctaattttgaatcatatctattattctgtcccttccctcagggataacatcccattaaagtacagcacccaccttggtgaccagatcagaatgcctgatgattgcacgaacaaagaacctgtagtctgtcacttctgtgcccacttccaccttggctgccccgagatacaggtgcatcttgtgattagcacatggaatggcagtgaggtcaaaatttctcatccggttcagctctaactggaaagccagagcaggctccagatgacgatagatacgatcctcctcaaactgagtacaagaatcagagaaaaaacagttcacaagaggcagttacaaaattatactatgaatgtgaatgtaaaagagatgcctgaaaatagaaacataagctatgatgtgctaatgagcaacaaaaatgagctacattcaaggctaatgctacagcttacataagattaggcactaaagtacctattatataggtactttataggatgatattcctaaactttcatcatttatgattttacaagtggtgatgatatacatgaaaaacaaacaaaaaatcctcaatttccttagaactcctacaacatttaatgtctttatataattcatttttatattaattacaggctgcttcacattaatatctacttcacatgccaatgttttgagcttacccaactaatctaaaaattttctcacttatgataagtacaaaggacataataaatactcaacaaagaaacatcatacaattttttaattaaagagatatttggctttggaacactatatccatagatatataattacttatatatgttttttaaaagttgtattagtatataactttactgtatttactgtatatgtactgtatgtttcagtgaaactaaagtatttttctggaatacatgtcaattgagtgaatggagagagagagtcaaatatataagccggtaacaggaagaaagcaacatggtctgaagttttgtattttaaaattgaaaaacaaattcacataaagtagagttgagtatcagtgaactatttgtagataacaagaatggtcctttaatatcacatcattaggatcattctacaggacaaggatgatttggaaaggtatcaccttcgttgagtagctcaatacatttggttgtttcccaaaccaaaccctttcagaaaggaatcggctttagttctaagacacacgtaaggcaacaggaagcacaagttcaataagagaaaaaagaatggcaagaagaacgtatggcaaagataagccgctcttgggcttttaagaaaaagtaatttttttttttaaataggaaagaaatcaatccttaccttatcccttgctcggaatgtaaaaaatttagggaattctctctgtattaaagaagggggaaaaatgtgtcagtagttcatagacatggctctttgagaacaaacagtatagaaacagttaagcatttagaagccagttttctagaaaaacatgcttcttacctaagcttagtccaggaaatatatatgaatgatcctccgcataaccatcactttgaccccatttccaaatttgagaatcaccacattataaacctaattttagtatctaccctctcccaggggaaaaaaaatgtatgaattttttaaatctcccaagtgaaaaaaatttttttgctaggtattgctcttggcacaacccagcaaataaaaccaatatacccttgtgccacagtcactgcaatagtagttaatggactgatttcccaagttactctttaagaaactcttaaaatataaactactcagacagtatagagtgctcagtccatgattttcacatttattctcaagtcaataatgtcaagggtttaaatgataacatttgaagatgaagaaaaatataagattctaccttggtcactaccactatatgtataggaaagaataaggttagaactagtgaacttgtaatcattaggtcttcctgcttttttgtagggcattatacaaaaaaaaacccaatttactagaaccttattaattaacaaagatgaattcaattagcagagttcattagtttctgaaatttaacttaccaatgccaaatacccctgtttctcggatgggaagctctactggcagtgctggaatcaaatcattactatttgcctctataggaggtttcattaggcatcttcttcattatgagtgcaatataatcaaacacttatcagtacaaggcagagagaccgggactagctgcctacacatcctcaatgagctttaggaaatgtgaaggaaacatggactgaaaatcttctggtggcaggtactctcatgtgttgtcctatctgatgctctcaacaacctctaggggtagatattgtgaccctcatcttgcagaagccttggctcaagtatatgctcagaatcacagagctggaagataaacttgggtctctctagtgccagagcccatgccctctgatctctcaagggcagagtattacctttctctttttattataatctaaattcctcatttagaggatttctctttgatgagacaaaaacacagaaattaagactttaaatttaaaaagcagaaagcaaacaaagcaaaactcatgctgtaaacctgtggttcttgaatttcctgaaaatttcttgaatacgttccataagtgttacacctcactctcaccttaactaaagcttgcacagttaataaatctttttatcttttccttggtattttaactgtaagactgcatttaaaaggttcctaggagctcatttaccaacctcagggaaatccttttttaaaagcctttttaaagtggattttacacaggactgaacttctcctcaagttttgttctaaataattctctgacaccgcccccacccgttatgagagtgaagcacataggactgacttcaaggttaagtaagatgcattcagctgaggtgtcgataaatatcatgctcatggttttatataacctagttttggttttattctagtgaggtacagctttcagagcattacctaaaaagtaacaaatgtcaaaaaaggaagaatgacaaaatctttccatggaactctctgaaagaaaagtcaaggaaagtgataatatgatattttacgcacacacttttctattccgccttaactattattagctaattaattaaaatgtttgtttaggatgccatttatttaattatgtacatttataggatcaaaaccatttcctttcaaaaacaaaacagtaataaaaaatgctttcttttccactaaaccaattaagaaaatttgtagtaactgaaaggcatataaagcagtttgaatggaaatgcctttaatacaaataatgaagaaactgactaattcttggcagaggtgggcaatgactaccaattagaaaaaccactttcattaaggttagctaagaaaagttgtcatgagatcatataaacaactttttttttttaaacttctgagtaaatttgtaactccccggtaaaatcctcaatttaagtattaaacattcagaacaagagatggcaagaacctctgtgcaatggaaaagtggaactactaagcaattcttcagtgacatggaagtctgaagactcttacaaaaagtaatctcttttggcactcaaaaaccacagaatcacagaaaacacagaaaagaagaaatctaaaagtctgatcctacagttttagtaaattcttttatcctatctcatcctcatactgccagtttttccactgaaagcattcatgcttattccatcatcaatgtatttgctttccaagtattctactagtgtcatgggcgaatatcataattgaatgtacacaaagaaaaaccctcttagtattctggtaccaaaaaacaaaagaatgcaacgtttcacaggaagaaattatgcccttgctgtgttctaatcagccaaccatcatcaagacaatcaaaataatttgcccaaattagccaatcaagacaccccgcaaatcagagaatgtgaaaacctgcaacaaaaaacatcatagctgattatgatactaataatcgtgttaaaaacctaatgagatgaagaaattgggagcttgctggtacaattctcttttacctcaacatgctgagaactaattatatagactgtaattaaaacaaaaatccaaaccaacccttctgaaaactaatagttggtccactaccaaacagaactatcttaaaaaaaaaaagaaaaaaagaactactaattatgataactgctcatatagtgagctcttccttcaaggtccaaataatccaaaacatttcattttaaagtgggaatcacacaatagtcataaaacaacaactctctctcgggagatatgtagatcttttttttaaatctcatgaaattttacaagaacaaaaggtaacattttattaacagatgtaaaactgtttgatttagaatcttatcatggttttaggacttaatgggggataagaagaagtcctgaaaatttgtattccgatgtccttagccaaactttgctgaaaaaaatatggaaagcttaaaaaaaaaaaagcataatattatatcccaattagacagcactttctgctaaatattttggaattccagacctaaaatgtgagtgaaactaagacagagtgagtcaataagttttaactaacagaaaactgtggagttgcagtttagatagctgcagaaattcaagaagcctcttttccattcaagactttgatcttttttcttttttttaacatcttgtccatttttttcttttattttttattttcagatgaacatcatgatctactttattttttcttaacaagtagaatatatttacaaaaagagacttgtttttcctcaaagtttctgtttaaatatcaaagttaggcagttattcaaattccattatgggcacttgatttaattagatggttatggaaacagagtcaactcccagcctccttaacactggtgaagactgctgtcacagaaataatctccatgcagtgtcaacggactagggtggcaacagacaccctaaaaatgttttaaagctgtgggcagctatctgggacaactgtggctaaactacgaagtattgtaaatgcttatagcaatcactgtcatccaaatcagtacctaacaatatacacagctctctagcaacctctactctggccctcatttgtcttattctggttctgaggcaatttgaaagaccaacaactatataacagcacagcttgctttattccactaaccaatgtgcttgaatcaaacttggtaaacttcctcctctccttgctccctcaagtgcaaattctctcttccattcaataatatagggattccacagcattggacaggggaggctgcatacatcacagtggattatcaagaagccagagagatcaagggattcatctctgacactcccagaaagcttcctctttttcacagtacactaactatggggcaagcacaatcagatgacatgacagaggctaaataagcatccttcatgaatgtcaagctaccatcagcaaaagaactcacagcagcaccacgacagtgacccccagatttgtacagtttctgccaacgcttcctggctagtgtagatcctggattgtataatagattctggatggagttcggtttaatagttgcccttgcaccttgcaaaatcacttatcatttttaaagggactaacataaaaacaccccaactcctctgccattcaattcttcagagcaaatgcagtcctcacttaaaccttaatgttctctatgctctaaagcagcttttcctacactcatgacaaatcaagtcacttgataatttaagtgatttcccacttgatgccactatatataggaatcagacaatgattgtcacggaagaccccctgctggcctcattttctagccgattttgcctatacatgtccctattaaacctagatccagaaatatcaggacagcagagagaaaaaaatgttttaaagctgttaagtatactcttaatactagggcatatttataactatacactatagattcagagataagaaagggtttttttatgtgttacatatatgagaaaatgtcagtgagaactaatcactttggtttgctaaaaattttagtgaacagttttagttgatcagtgtatttattatagaaaccagttagtgtgctatagatgtgaagattccatctaatccattagcaaaaaggaaaacaattttacaaatttagtgttattccctagaatatgctgttattctaaagtcggtgataaaaagcacagtaacatttaagaacctagcacaatactcttctaaaatccagggcctggctctggcatgtctaccttagttctgatcagcatctaccagccacagtgtttatccatgggctttcatattctatcccaaagtatcaattttattctctaagctcctgatttttcttcctaaagccctagggttctttttaagctcctcatacttctccactgactccgtttcctatctaaagttattgattgacatatatctacactctgcttgatttcctgacatcaataacacaggggagtcatgcagtccacaacatttcctaaagcatttcagaaaatcttagctctcttgtttctctatagactagaccaacaaggtgaactgtatgaaggaaaacaaaatgtcaagtcttgaaaacctaataaacaaaaaggtaataaaagcaatcacacataggtccttgagtttagaaagtcctttccagaatctcaagtgccatcttcattgttgcaaacaagcaaggcttaacaaccaaattatcttaattgctaaaaccaaaccaaacaggctgggcacagtggctcatgcctgtaatctcagcactttgggaggctgaggcgggcagatcacctgaggtcaggagttcgagaccagcctggctaacatggtgaacccctgtctctactaaaaatacaaaaatcagctgggtgtggtggcacatgcctgcaatcccagctacttgggaggctgaggcaggagaattgctgcaacccaggaggcggaggttgcagtgagctgagattgcgccactgcactccagcctgggcgactaagcaagacactctctcaaaaaaaaaaaaaagaaagaaaagaaaaaaaagacttcttaacatcctctagaatcttagttagctacattagaatcaatttttatgaaatattttgattataatcagtcattttgaaaacaacatattgattccaaactggatttctggccttactgttgtcactgtactgggtatgatcatacgggtataccatagtttggatgccaggctattaacttaattctcttttcaataaaaattttaatctcataaatattaacagttaattcagttaaatgggagaataagcaacagagtgtttaatttttacttatttcctgttcctacgattaacataagacaaaaaatagcaacttggctctatcaaggcattttaaataataaatcattgttctttagaattgagacttctcaataaagaatccaagaccacaaaatgcaactggctgtccttgattattgattcactataagcacagaagaaattactagttagcttgtttctaccttatttatctggataaatgcttatgttcattcttaactatttctcagagatatattgagaattcattatagggttaaaaaaaaaaaaagaagaaaacctttagctggaacacttgatataagaattaaaaaaaatttttttttaattaatagaggactgggtctcattatgttgcccaggctcatctcaaacttgtgggctcaagcaattttcctgactcagcctcccaaagtgctgggattacagagaactgaatatttattataataatttctaaaagaagaaggatcaaatatcagtccagcccttctaacatatattctggttaaataatcagtggcagacaaataaaacagtaagtaatctttcattattgttcattttacttacatgaaatctccgatccacctcatagttgacctgctttctgaaatcctttcaaataaaagagagaaaggaaggaaagacagcagaagttggcaattagtaacaaaatcaaaaagaaattgagtaaaagatgatgagttaaactaatgttttttaaaaatgaaacttacagaaaagtggttatttctctgcataaatcctattagtaagcataagattacaatcccatttttattaagttgtagcagcagcataagaaatattaaagaggtacaattcacatgtcagtaccttttgtgcaaccaggaaagtaaggcgccggatcccatggtcaaccagggtagctttctaggagcaaaaacatgtaaaacagaagatagatgagatttccattcattctaaattttatcccattcggcccttgtaaggctttggtggagttaaacatcctttttggatatccttatcttagcttagtaccttcaaacttgcaagtgaacaaatttcaatctggctcctaggactaagtcttacgaaataaattttatattgatttggacaaaactgaaagagaactttgtggaggagaaagggtgatatgaagtcaactaaattacctcagaactgatttacataaaggtaggccatgacacaatttctgcttatagaaatcatactgttgggcatgtattcaaatgtaaacattaatattgataaagatgctaaatgaaattaggtagagagaaaagaaggactttccataaaacataaaacacaggtcctaaactgtttagattgtagatgttacctaccatcagatacagcatccctagaattcagtctaacaaattgtaacctttcagttttgatacaacagtccccccttaccttacatgaaggcattttttaaaaactctctcttttaaaattgttaaaagcaatatttaataggcctttaaatttaggaactattcatatctccactaggcataggcgactagtatattagaagtcaacagaaggctgggagtggtggctcacgcctgtaatcccaacactttgtggggccaagatgggcagatcacttgaggccgggagtttgagaccagcctggccaacatggcaaaaccctgtctctactaaaaatagaaaaaaatgagccaagtgtggtggcacattcctgtaatcccagctacttgagagaatgaggcatgaaaatcgtttgaaccaaggaggcagaggttgccgagattgcatcactgtactccagcctgggtgacagaatgagactgtctcaaaaaaaaaaaaagaagtcaacagacaccagtagtttcaagacagccacttatacgagtcttgggcatctggacctaaagccttcctcttccctatactgttcacttgcttcaaaaggcagggacaaagaaacaaattaatgaattaagtaaaagacatgtgtttagaggtccccaacaaagaaggattataacagcaagcagaaaagcaaccccaccagttgaatgacctgagaaaacatatgaatagtacaaatagaaaagtaatgtggactttcacagcctacatccagactttagtttgaccacatttcttgctataactccaaccaagagatatgtttataggccagttcttaacattcatgatattatatattttttaaaatttaaattgtcttccccttataaggaagcacattcttgggttatttcttccaatttcttcaattctgcgatggcattgctgagtaataaaattaattttattaacagcataaacaaaagataactggaaaaattaattttctataagcaaataataaaataataaattatcaggccaaatataaataaattttggtttaactgcattaaaaaattatttgtactgccatcacacaccttgctgtaaataaccaagtattgacacaacaatatgaaaaaaatgtgtcgaaggaaaggaggggtttctcagtgtggccaggaacagaaatacttcttctgacatcaacaaagattccactacagtcaagtccttcaaagacaagcatcagtagctatgttctggcaagggaagaaaataactttaataatgccatgatttaaaatcaaaattgttattgcttttaaaattccacaagtggctgacaataacagcagagcaacaggattctgattacattgtaataatgcaggtctcacagcaagtccacagctattacccagcgattaggcatcagcacctggagaaactccatttacactgactgcttcaatctcctccacaagtcatttacaaatatatgatcctaatttctatgagagaaaaaaagacatgctgggactagaagattatttggacaatttggatcaacctatttgatagtttaatgtgtgccttaaaaaaaaaaactttttctaaactgctaggagcatgatcatgaagtgaaaaacaaaactagttgccactttatcttttgtttttttcttaaattgcttttctttccttttctttcatatatatatatatatatatacacatatattttaacaaggagatgaaaatgccaaatgtccctggataagcacagtacctgatgcagtaaatagcttctctatgcttagagtgtcagcacagtctacccttacctttctaaatagccttaggcaaagatattggatttctctgtgccttagtttccacacctagtcaaggaaaagggtaatttcttatttctcattaatgttacaaacatatgtagcgaatatgaagaaaatgcttttttttttttttttaattgagatggagtcttgttctgtcgccaggctggagtgcagtggtgcaatctcggctcacagcaacctccgcccccaggttcaagcgattctcttgccttagccacccgagtagctggcgctacaggcgcccgccaccacacctggctaatttttgtattttcagtagagacggggtttcaccatattggccaggctggtcttgaactcctgaccttgtgatctgcccgccttggcctcccaaagtgttgggattacaggcgtgagccactgcgcctggctgaaaatgtctttgtagatcaacatgcgttgataagtatgacacttagatttgagggcaacaagaagtgtcaagttgtggtcaaattatggaaaaatactcaaacatgggcaattagtgcctcaaaacctaggaagaaactttcacagattatttcatgaagcagcagcagcagcagccacatataatattaagactcttccaggccgggcgcagtggctcacgcttgtaatcccagcactttgggaggccgaggcaggcagatcacctgaggttgggagtttaagaccagcctgaccaacatgcagaaaccccatctctactaaaatacaaaaattagccgggtgtggtggcgcatgtctgtaatcccagctactcaggagtctgaggcaggagaatcacttgaacccaggaggcgggggttgctgtgagctgagatcgcaccattgcactccagcctgggcaacaagagtgaaactccatctcaaaaaaacaaaacaaaacaaaacaaaacaaaaaaactcttccagcaaagattaccttgatcactggctttaggttaattttatgtggtcactggccaagggcaagaaggaaggtaaatttctgtctacagaaaaagccctaggcatatcccctactttcacttctctggaagcaccttttcctcatactgaccactgcaatctcatagttagtttaagtgctacaacaccgtcatggaataagtactaagactcatagtcatcacaaatttaccattttttcccctagatatctaccattggcattacatgatgtgaatgccaatggtacgaactgtctacaccactgaattaaattttgaaaacatctactgagttctttctctgcaagaagtccatgggctaagtgctgtccactccaagagaacacatgggtcttgccatcaagggcagtttaagaggacactttgctatctatcacatatcataatgaaatataactgtagattattgttttaagcatgcctatcctgtcccctcaactagactataagcatcttcagggctaagaatgtattatttactaaagtacctagatctgtgccccctatacctggcatcaaatccttaagttctagtatttgctctatcatcttctagctggtgacctaggggtcttaatttctctgagctccagcttttgcccatgtgtacaactggaacaattcctgacttatctaaccccatggaatcgtggtaagatgcaaataaaaaatttaggtagaatttttttataaataaaaggcattattattgctaataaatgtatgctgaccaattaggaattcaaaggaggaacatacattttagttagggctactcagaagtcctcactgaagagatgaaatttgagacagttcttaagacaaacaagatttagaaagaaaggtgaaagaaaactttctaggaaagaggaagtcaaagaagtataataaatgaggcacattagacaatgaacacaggtcttttcacaaaatagcaaaggctacatgttagtctctcaataggctgatgatgttgaagctaaagttaaggaggtattctgaaggtcagagagaatcactgttaagtgggaaaataacatggtaagagcacatttgggacatttaattttgtggtgatgagcagaatggaaactctttggagggagaaagtgaaggaagataagtagatcacaagtaagcctgctgcagtgtctcaggtataagatagtaagggtttgaattagagatggcagtgggaattttaaaactggaaagaagaaaaagagaaagggtaaaaaagactgcaaagaaaaactaacagaccttggtgactgaccagatacaaataaatatgtacagattgtgggtagaggggtagaatgaaggaatgtcaaggaaaaagtcaatgacttttgaatgattgggagtaaaaggtatagtgagttgtgaggttttttgttttgttttatgaggggattggagagggacgagaagaggtgaagcaaaatgatggaaaatgtccatttagacgatggcgtttgatgtcaacaggagatatccaagtgacgtaaaattgaaaggaggatagatgtataactgatagtttcaaaggaggggaggggaagacacagaagggacctaaggggagtttaggcttagacatgtggaaagtcaccaaaggaaaatacttggtaggtgattcgaagttcaagactggagctctgggagagatttaggaagataacttcccttaaaaacattttaaatatttgaggtctattatctgttgacacacaaagatattcattatatattattaagtcactttgggattttatccctaaacgcagaactagccatagttctgagagttatgataaaagacatagccataaactagcaactgataaaaggatagctatgatacacagccagtagaaaggggacatcacgagcttccacccaatcaagaacttacattttgctgggtaaattctctgaacatagctgccagcctgtcatcctcaatatcacagtcagtcttgatagccacattgagaatgtgaattggttcatccctgggaacctgtaactcaagaacacaagtcaaagaaattatgaggctggccaatacagatgcagatagaagttataatatttggtagaatacctgaaaaagagatacaccccacaggatattttggtttgcccagcagtaggaatgagcaaattgaaaccactgcccaatagccacagagagattaaatcaggtaaagcatataaattttaaaagataaggcagcagaggcattagtaacaggtggcccaatctttacttggcatgaagctgaagatcactatgtctcaccttttttaccaataaaatgggggtgaaactatttgccacatctcttcacagaatgtgaaggaaaatgagtgatataagccatctggacatgttcccacataatatatttccttacaatttatcaaacaatggaagtatcaaatcatgaaaaaataacatcatagagaaagaataatttatttactgataaataaaaagaaatgatttaataaaaagacaaagttttcaacaaaatgcctactttttttctgtaatctaaagtcctccattctctgaggactatgattgcaccactatgcaaaaatataagccatggctgagtaagaattccagcaaccaaagcccaaatccttaaaacaacattcagagattcagaggcagctgcaatggacatagctgagcccactctatactatggactccaaaattaatatagtttttttaagttaggatttatattccacttgtttccagaaaatactttggtgaggcatacaaaattaaatactataaagtggggtaaaaggatgaattctttcctataatagttcaaagtcagaaagatagtatacagtagaagtcccatgtctgaggggaacaaagcagtctcccaaaagggacattataccttatcctcatcataaagagacgtgtgacctgcctcagggaatgtgggactctggggtggggagtcagagaagcagcccatcacttcatcaaagatcctaaaaaatacaagagaaacacccaccatgaaaactcaagtggcatgaaactaacactgccattggcagctgagtctaaaagaataatctatcttagcctgggctcaatagttaattgaacagaatcaccagtggctagaggtgacatgcaaaatttcaccaagtggcagaaattaggaggatggattgtttaaactttaataaaccatatatattttttcttttttagaaagaatgatctaaagcttttttgtttgttttgttttcctcatatgtaagatatgagcacttctgtcatcatcggtcttaaagtaacagaaagtgtctggaactggagtagtgacagaccaatgtaattacccctccccctagggtaatgcatcagtatacatcaagagatagatgctgaatgcatttaatcaaaagatgtattgtctcttgtggggctcactctagtgttatgtttaatttctcctgacatttcactcatcacagagcagacagcttcttctgttagctccacaggaaaagatggtttttgtttgtttctttttttctgaccaggcccatactacaagtagaggcttgtagaatctgaatgagaggtagaaatgcaaggatatatacctctccaacggcatatacagcaagggttacatctttttagctggctcatggctattcgggagacctttattcattttgcagaaagatgagaccccaaaacacagatgtccatggctccccttgtacagacatagttccacaatgtcttacctgacaaaatcttcaaaagtccgaaaagagaccattccgcccatccgctgacaaggtggagtgaatgagttgtccaacagtacatcgctgacactagctacatgggtcatgccatagtggttgaggttggaggagaaggacattctaaatggtaattcaatcacgttcattagacaaggagggtaggagcaaggactgggaaagtaacagtagggaaaaggaactaggagaaaactctgaagtagggtcaggttgcagagcagatttggtttttttacccactatggataaggttgttttgctggattcatgttaaccctttcttttgaatttccctaaataaactatattttcatcactccaaaatttcttcaaataaaaagctaagaactgttaggaatttccaggcagttttaacacaattacattataagatgtccaatgaatgaatagcacataggggttaaaaaccatcctgcatcttccccctccctaaagcattccctcctttaaaaggaagtaagcaagccaagtgagttgtaactatgcaatgcttaaggcattttgttttctaggaactgtaatagagtaagtattcacagatacataaagagataggtatatatatgtatgtaaaacaacaattgtaattaagtcacctggaatggtttagtaaataattatataaaacattagggtacagaaacaggtcacagtctataaaaggaactttactgaggaatttactttctcctttaatgggttggtaggcatagttattggggttacagttctccctttttgaaagagagctatttttcaaccccaaattgcacgtttttcttttcatagttaagcacttctataccaaaacaaaaaaatctccattgaaagcccttaataatttccagcaagatacaaaagggcagagcatgggtctcaaagtatgtgtaagcatgacaagcagctgctaaacggagatgcctgaagagaactgaactgatttgctcaatctaaaaacaatgaatctctatatttcttgatgtaccttaacagtatgtactgataaataatactgtaaagtgtttctgaatgctcaatcaggacagcctgttaggaaggaccaagctaaaggatgcctccaggacttgcctgacatgttaccagcatactgatctgaagcaagttcagggcaaggcaatggcacttgaatttggggaactgccccaaaaatctccttgaagtacaccacctgcggtgttgcagggggaagagagacgacaacgtggacttgatatctgggtacatattgtaccctatcgcaaatcataattacaaggcaatggaattctttgtaggatgggagtgctgctcacacagactatagagactgacactccaggtttttattcctttggcgagtgatgactatggaaaaggtacatcatcttttgacagtacttgggagtagaaggcaaagtgggagaggaaaccattgatacaatgaatgaaacaaacaaatgaaacacacatcaagcaagtcttacacatggtgctcactagaaactgggattcagagttgtattaccacagaagtgctatcatcctcctcttttctaggatcaccaaatatatttactaaaaaagcaagtttgtgaggcattgtatcttttctacttgcttggcattagacaggaaagataaaagggttccagaccacatttaaagggaactccctctgaagaagttaacaaactatgtttgtggcaaccatggggttaagtagctttttcactcaactgaaccccatgggaaatatcgactattcagtttcccctcactgctatgcttgtgaaccagggtggctaaaggcaggcaggaatgagccaagcccactcaccaagggaagactacaagaccaattaaaagcattccctttcctctccacatccaaattgggatctaaaagctatgattagtcttgattacttaatattttaaagggagagggacaaaataaatgtaaatctataaatagttccacgtgtagctgattatctgcaaagaccttgccatcaacttactattgcttttgcattttgtggattcaattccaatcagaattgttatcctctcaaacttgcattgtgttgccttgcttggttcaagagacaggagaaacccaaaatactaaaatatcacttatgttatattagcctggaaacctccacacagggttaaacacatcaaaacttaaatatacttttccaatgttaatcttattataggtctgaaataaaaactgactatcataacattttaacactttagaaaattaactaacaaactgataaaacatgagatcagctatttctggatctgcactcctctaaaaggagaagcaaattagagaaactaaaaattgtaaaaactgtgaataatttgccaggataggagtaaccttaagggtttctcctctgaaagccccaaactacacagagaacttagcaaaagaagatgttgctagcaaggccggacataaggcagataaaccccctatcatatacagctagatgggagcttctccatactgaggcttttcaagtagtgctttttgaacagctgaagaaaagctgaagccatgttttccaaacagaaagaataatttagtatgtccaaaggggagctcaggactccctagcagataacacattatcttgtcaagtgttgtggttttttttttcctggtttcactattctaagttacataaaggtgcttttaattggaaaagaaactaaacatacggtacctgtttagcgtagggatgttccctctgtaattaaacaaccacagttagttactgataagttagtgaaagccataataaaagaattgtcagagcagatatagaccagtcatgaggagctccagtttggcagctctggcattcagcagacataattaagtgctcattacccttcaacccccaggatacctccaaagaggcatgctcctaacctacctcaccacaccagctgttgatggaaagggtcaaaatgtatttaccatggattttaaaaatagctctattaccaaaaaaaaaaaaaaaaaaaaaaaaatttagagtagtggtaaaacacaggctgatgaaaattaatttaagctatatgatatggtatattaactcaagcttcaataagaaatataattcttcacaggattcttagagactcttctttcttgttcctattactgaaggtgtaataaggaggtccagggaagttgattccacagctcctcctactttaatcgcttatccaggatatgtgacagacctacaaattctccaccaaagaaaagtatccaggaatctgggttcccagctacctgctctaagtctttttaaccatactcttcctcccatgaaggagagcaggggggaaggtactgtattctaggagcttaaaagaactgaaaatcatgcaggaaagtaatgataaatgattctatgataagttgttaaaattaattaatactttgtaattaaatgagtttagggtcataatgattttaaaaattgctgttagcttaaaaactctaggcctctcataaataaaaccttatctaaatttgactaccacagaacttccttataaagaatgtgccaaatcatgaaagaaagaccacgataagaataggaaactacaaggcacatctcccacattctctttggcctttgccactaactccttttaaaagatttccccaactgaaaaataatcaaacaaataaaaacctttattttcaatgttaaatgggcaaagttatacttaccacctacaatttaggggcattgtaagggggctgatcggttgatatcttaaccttctaacattcttttatcagcatttaatcactgttggggttttctagcacacagaggacttaatgggcagaacatagtgggtggtgctgatgatatgtggaaaggaagatagagggaggaaaacgatgcactttccatggcagtagaaggagcagaatagactgagcaggccatataaataaaaagctgtgacatatcactgcacacaaactgtatacctcatgtgatttgtgagtagaaatgctctttgcatcaaacctgtatcacagagtgaattcataagacagcaagagcaacctctgagtgcagaaacctgaacctttgctgtttggattccttaagcctctcactcaggagagtgggttttatttttacaagagatccttagttataatgcacttgggcctcaacaatacagaaaaaataggcacaggttctagaacagagggaggtacagctgaacagaaaactaactgcagatgctaatgagaatagttttccttttacgatataaaggatgctaaagaaaggggccgcctgcacagtttcttagcatgaatctcagttcagagagaactctacaaccaaagaaacctcaggttccattcatccaggtttctagagtttagaaaccagtataatctctctcaactgttaacaaatttcctaatctaataaaataatctaactgcttctgtagctacattctaatccctttgggagtcttcacaggatgacggccatgttttcagtagaaaaaggcccgaactgaaaagaacaccaataacaacaaaaagccaggctttctccatcagcaactctcaagctcctacagagagccccctgctgctttgttataagaattatgcaccatctacacagtatgggtcaaaaagcaaaaactcccaacatctctaatttttaaaggaatggtcccaaatcaatcatgtaagtaggtttagagccagcttatccacttaggtagaataagaatctgtggggatgtaagggagataagcaaggaaggaaggaaggataaactgtctattaacagataaatatttggtcatgtccataatgatcatttacatgttttctttttttttttctttttctttttttaagaaatagagacaaggtcccactatgttgcccaggctagtcttgaactcctgagctcaagtgatcctcctatctcagcctcccaaagtgctaggattataggcatgagccagcaaacctggccactacaaatttttcatcctatacaagggctatatggtcaatttaagaatatgacaaatgtggcatatcgcacactactgtgatacaccagaaagctagattaacactctgtaccaaaaaaaaaaaaaagccacacacacaactaagggaagagattgtatacgagtcaaatattccatttatgtagctgaaaataaaatttgccacattccactgcatactcatcacgcaaaaatagtcaaattaggccgggcgcagtggctcatgcctataattccagcgctttgggagactgaggtgggtggatcacttgagcccaggagtttaagaccagcccaggcaacatctccaaaatccatctttacacacacacacacacacatacacacacacacgcacacaaatataaaagttagccaggtgtggtggcacacagtacacctgtaatcctagctactccgaaggttgaggtggaaggatcgcttgagccaggaggctgaggttgcagtgagccaagatcatgccactgtactccagcctgggtgacaaagtaagtctcaaaaaaaaaaaaaaaaaaaaagtaaaattgctcaatctttgataaggcaatcaagtatattttcaaatacataaatgggacataaattcacttcctatctgctgtttgggctattcaaaacacttattataatgaatcttcatttacaacatttgatgaatattagaaccactttctttctagtagattagctccattttacagatgtgataaccaaaaaaccaaagaggatgctttccaatgacattgttcaatatggtgtcataaaccacaatctagacttggcattttcttatctccgctctccaagttagcattccacatcagtatagattttagagaaagacaagagaaatcctgtgaattctgaggttcccggcactaagtcacctctgattttattgctctgcctgcccagaatggctggagagcttgcttcaatatgaatgcaaagtcagagttgccgcctgctagctgaaccctctttaatttaaagaacactgacttctctggcagccacaagttctgtgagcctttttaccatcccttccagctgaatttcatttggcttgattctagctggccttatataaatcttttatcatataaaaatgctcctgattcttttgcttcctaacttgaagaagaaaaaaaaaagagcccatatgaaaatgatggggatgcatgcaaacaagcagtggttacatcaagctgtgactgaaagccagtatagggcaactcttttgaaatcaggcagcaaagcagaatcagaagaggtcggctgaataacctactagcagccactaacagcagtaccataggagaaagagcaatttgactggctgtgaccagtggtggtctctttgcatgactatatttctgcaggaaaatccaaatcaagaactgtaaaacacatctgaaccacgtatttctactggcatctcccccaccacctccttgcagttcagatgccctgagtctactgcagagctttagtttacaataaaatgatcattacttcattcatttgcagcccctccaaagccccttctttgctctgctggaaggttttgctctttctgaaacaagtacatcaacagagctacagcatattactgttgcctgctatataattagctacgaacccacagcacaaaactacggggatttacaggtgtcctggattctgcttttccttcccccaggactcagctagtcttccttgacaagaagggaccttgggctaccctaatgatatattgagagttttaaactcaactctccaatcttacaagtctagagtgccaaaataacacagcagagactagaagctgagccacggatacaggaaagcactttggtaagcacttaaacctgctgagaatcttctcttctgccagatacttgcatcttatcagcagactaccctgaatgaaggaagcaagcactgtaagatttcatttatttatagctcattctggcttgctaactacaacaagtgctcccactgcagaaacaatgctacaagttggatgacttctgagtatctcagtactatccaaagaaaggtctaatctctgggtgttaaagattatcagaattcttgagaatggcagttggctaccaattagtcacatggaaggctcctgatttctaaccttccttatgaataaaaagtccagaggccgcccactgacagctgaacattgaggatggatgccaagcagcctaaactcagccatgaccaaaacacatgctatcaggggaaaacacagccgacctcttctggaggtaagacttgagaaaagggaagtatttgaattaaaacattataacacagaaggccaaattcacaagtagcaaacagcagagaaggtacagtggaatccgacttaactaaagcatggatttccatctatgaaataggtggaaataaacaccaataggtcctcacccattatatatgtacagaaacgtacaacaaagtacacctccatctcctgcatcaaatgtgatgcttcttatttgaatcacagagtaaaggttaaaaagattactcatgttcactagcgtatattaattataaaaatcatttggagttttaaattgtgtactcccagactgtcatattatattatacagagtcatatgtataggcacaatttatgggataatatactttacatatgtttgtataaatataactatattttaaaagatcaaatactagttgactgaagaatttgtttccagattatcctgaggcacttaatatgcccaaagcttagtgaaatcctgaaggtcaaatgagtcaatgaattgtgcaaaatacagacattcaggatgatgcttcagtgtaacaagctttcccatcaccagcaccagtgagtgatacttaagtttctgaataggaaaaaagacagacatatacaaaacttgggctctaaaccctaagactcactagggaaagaaggagaaaaaggaatattcaatgatatagtttgaactccagggttaattcatgtaaaactcactaaagggctgggctcacagaatcttcaatgagagaattaggttctagaagtctgcacaataataaaatgctcccttagtatagactagttgccctgaatattcctgcaccatgaaaacaacttgagatagtcacttctccttcaagaacacaagtcagttaaaaaatgacacattaaaaaaaaaaaatcccctcccctcaaaaagaatcacacagcctttaatgctaagaaggtaaaaaaggaaacacacacacacacacacacacacacacaccccatacacgttacatatacatacacacacatgtgtgtgtgtgtgtgtgtgtgtgtatatatatatatatatatgtttctaactatgcttaaatcagaaaaatctctttagctgctgttcaagtgaaggaaattttagaagtaaagggtaaatccagaccagaagcttgcctgagtgaagttctaataactggatcctctgctgaataagacctacagatgccaaataagttggaactacagtccccagaaaaaaaatttagaagtcttgggtagaagatcaaaaaggagataatatacctcgactgatgcacacctagcaagaaatgaaataggaagtcacacagattaggaataaactatttagtaatctgctttttaaaaaaattattggagtttttttttctaaaaatagtcgaattataccaaaaaacagagtaaccgcaacatgtcaaacaatgcaaagtcctatgatgaattaaaagaaaaacaaaaatgtaccaaatatgttactacaaagcaactgttcaagtgtgctaaaaacaggtgtcttctcccttttcagaggctcccctagtcatttgcaatatattttgcctacttctctaaaaatcaaaataggtcctaataagtaagatacaggtcttcaatcccaacagcaactaagggattttcctgaataaaaaaaaaaacaaaaacaaaaacaaaaaaaactctgctgccagtttgcagacagagtgccgtgtttcaccccaacctatggaggctaaatcacagtcaaaaacaaactgcgtgactgggaattatagtaagaggagttaaaaacaagggcaggtgcagtggctcacgctcgtaatcccagcactttgggaggccgaggcaggtagatcacctgagttagggtgttggagacagcctgaccaacacggagaaaccccgtctttactaaaaaatcaaaattagtggggtgtggtggtgtacgcctgtaatcccagctaatcgggaggctgaggcaggagaatcgcttgaacctggaaggcagaggttgtgttgagccaagatagcaccactgcactccagcctgggcaacaagagcaaactctatctcaaaaaaaaaaaaaaaaaaaaaaaagctgcaggaatggaattccatacacaatgagattgcagtcttgctttgatattacagcttactaagacacttctaacgatgtgctggacaaattttgtctacttcaaaaacacctagctaggaatgtgaagaccaagtgcaaggaaagaaaacacaaaaaattggttaaacaaaatactgtggctcatgcctgtaatcccagcactttgggaggccgaggtagacggatcacaaggtaatgagatcgagaccatcctggctaacacggtgaaaccccgtctctattaaaaatacaaaaaattagccgggcatcatggcaggcacctgtagtcccagctactcgggaggctgaggcaggataatcgcttgaacccaggaggcagagcttgcagtgagcccagatcgcgccactgcactccagcctgggcgacagagtgagactccatctcaaaaaaaaaaaaaaaaaacaaacaaaaaaaaaaacctgttttctcccccaataatttttggtctgtactaggtatggtggcacatgcctgtagtcccagctacttgagaggctgaagcaggagaattatttgagaccagcctgggaacatgacaagaccccatctctatgggaggggaaaaaaaaattggtttgttaacctcaattgggaaaaatataaaattctgttttatattgataagtaaaatatgtatgattcatataccttttctttattctcactgatttttaaagcatgcataaaatattgtagtgtaacatctataatatcaactgtgaataattcctgtaactactaagaataagcaacataagaataataatttttcctctctccacgggcactaccagtaacacaaaaaaaaaaaaaaaaaaagagggctcagtgtgactgtcctaattaatttttggtctaagttgaactgtctaatatagcagccattagccacatgcagctagggtagtacttgaaatacggctagtttatattgagatatgctgtaagtatagaatacgtgctaaatttcaaagatacagtatgaataaaagaaaaaatattaacaattgttattacatattgaaatggtattttggatataatgggttaaataagatgttatttgaattaattttatctgtttctttttacttttaaatgtggccaatagaaaattttaaatagcatgtagcttgtattatatttctatttgacagtactggtttagaagtagtaactgtcaattatagctgttcatcagagttcagaggagcttttcaaagtggtcacctggactctaatccaaaatgaatcgggtcttgaaagtcaggactccaatatgtgtattttcaaattacccctcagataattttgagaatcattaatctagaggttagtggacataactgagccttacaggacagagtggaacaaatattggtagccctctgtaacttctttctgtagaatgagaaacaatatgcttttcgcctgcttgatcaaaacaataacatacaaaaaaagtactggagttagaaaaagaagaaaagtacttggctcaaaactagctaaatctaaaagagcttagatttctgtttaagatgagcaggcctattgtataataaagactttggccattgtctctggttcctggaagagagactaaatccttataatttcccaagtaataggagtgtcattgttattttaagtcccttggatcacacctgagtttatgctaagagatgagatgactcaggaggggagctggtcactagaaagaccaactgtgtgattagaaggttgagggctttcagccagccagacctctgggaggggagattgagtttaatcacgtaggctatgatttaatcaagcatgcctacgtaatgaagccctgattttaaaatactctggacactgaaggtcaatggagcttcttggttggtgaacacatggatgtgctgagagggttgataaactctgattccacagggaacaaactgggaagctctgtgtttgagaccatcccacacttcaccctaagcgtctcgtgcttttggctgatcctgacaataaaactgtagtgcttgaactctgtgagttgttctgagggaattatcaaactgagaaaattgaggggaccctcaaatttgtagccagttggtcagaagtgcaagtggccaggggaccccacttatggccccatctgaagtagggacaatttggtggtggactgagcccttagcctgtggcatctgatctaacttcagatggctagtgtcagaattcaattgcagtacaccagctggtgtcataataaggttataaatccaaattttaacaaaaacatttgggggaaaaatatattttatatatataaaaaacatatttttcatatatattatatatataaaaaacacatttttcatatattataatatattatgtatataatcttataaaactaaattcaagtagtaaatctgcaataactgaacaagctatactctgaaactgaatacatcattttatgatcaaacctgatcatttgatcctaaacagaactttagatcaaaaaaaaaattaaagaaattttaacatttttctggttttcacaaagatgattttatttttcctttttattttgcaattatcttcaccttcacagttataccaataataatgatgacaataacaataataatccagcaggtttagaattacactgacaaccaagggagacttcagggagattacaggattactgttatgttcaagtctgatctttatctacaggcatgtccagatgttgggagggactggcatataagttttgtaaccacattgaactaaccaagattcatactcttgacatagaaaggtgaataagatttcttaacaaagcagtcaagaagaatttctctcatttttcagccaacattccctcaccaaactggacatatcctcaaataaaaaaaagtaggacagggagaacaattaagagagacaaggagagtgatgaggagggaaggaaatcagaagcagccctgcagcctgactacaaatcactgcccaaagggaagcaggaaaaagcaggaagaaaaggagaactgccctgagaattacaaagagcattaagtacagcgtgtagttctctacaattattcaaggaatgcaggaaaagaaagaagactgagtgctgtgcctatgtgtgccatgagtacttcgccgctcactgaaggacaaccattcgtttctagaaaatgagattctgaaatccatggaggcaaaaatgtaccgagagatgcttgctaaatcaaggatatatgcttttctctgccagccataaggtatttttgaggtagagaagtgaaaggatattctgagacaaagaagagaggtactttttctgaagatgcctctgctcatctgccgacctctgctggatcaacagtggcatccagtggccaaaagtctcagcacagacttctttgtctccagaaagggtttctattgctttgggtgaagtggcaatttagaacaaaaccatttctggtgtctataactaaggttcccaaaagacacagtactttgtaataccaagtgaagaaccaaaggccataaagaagaaatggagaggggcaggttaagattggctgtggtatttatatttcctgtggtattactaaaaagaatgaaagtacaggaggggatgaacctatgtgtgggtggaattcctagattttcattgccttagaatactttttaaaagatagtctataagataaagtattttcattttaaaacaaaagcaattctgaaacaaaaacgtccatatgtacattttattttttaaaagacaggaagggacaaataatgtaattatcatggcttaattcagtaatttatttgagattaagaagtttggttctgcaatgtaatttttaaaaactgattgaatttcaactgctaaattcaggtggtctgttttagggagataatgaaactggctcagatataacctcaacccatagcaaacatatagaaaagaaaagcattccacccaaagtatttttttggtctaattgctgatttaaattgttaaaaagagtgatttttctggcaaagttctagcaagtaaaatgctagtaaattctttctaattttttaaaaaagaaagaaactatttcctcagtgacataatacaagcaagaatgaatggagtaatcctaaactttcatcttacttagaccataatttttctctttagatcaaagaagtgggcaccaaaaggctcttctcttttggttcatattgttcattttttgccctacatttctaactaaaaaaacatggaattgtcatacacattactccccttgattctcatggtatacctctggctggctcgggtgcacataccacctcaaactcacctgtttggatgagatgtgggcagcatgaactggaattccaccacacaggtgttgtccttaagctggcggtgttgtacgctgttaagttcataggcaatataagcccttcgaacatacacctggttcaaaagaaaccctcagtaaataaatttcaaaaacagaaattaagaaaatagcccagaaaaagagtcttgaaacgaggtatctgaggcagaaggtgctctgtggggagagaagtcccaaggccctatgtatacgtacatatattgctttaattaataaagctggagtcttaatactataaccatgactactaatgaaaacaaaactaggctgcctctgctggacacctatgtgcactgtaaaccttcttccacactaacctaaaccctggagaaggtttaatctttagcaaaagacagcatatagaactacaactattaatctattaagcatgatcatttcaacagaagattaagcagtgagaaaaatgagaggtgctgattttgagccacttacagagtgaaaatagaagacacaagcaatcacagtacagttcaactcttttactatctcatgtctttgtcttgcgtcctccccgacttccccacccgctcaaaatcagttttcagcaaactctgatcaaaagcagtaaggcataagcagtaagacataatttgacatataatatctcaaatacttgaacttgactcaagagttaaaggaacagcaatgaaataaaataaaaataaatataaattaaaaaaagaaacagcaataggctacatctctgcaaaaactgtcagtccaacctcacacatttcacagcaaatttgccatgcacataaaatgctacctgagattctatggcacgggaagtatataaggaagcttctcattaaatgacataaaaacactacaaaacacttaaatgttttaaaacttttggcatttactgagtaggataatttacactctaccacagagtacaaataaaaagtaacacaaaagagctggcaacagactaccgtgatgttacattacataaaatcatctaaaacactctttttccccatcttcaaaaaacaactatttggcaactttacagtggtattcagggcctgcaatttttgtgcttaatgaggtagtgtgctgtagcggaaacagaagtctttggagtcagattagcctgagttcaaatgcaaactcttccacttattatctatgtgattttggacaaatcacttaacctctcagagtctcactttcttcttacttcctaaagtaactgtaggattaaatgagaaagataaaatacctaaaacacagttcattaaatgctattactttctttcctttgaggaagtatttcataagagctgcttgacaatccaaacataactaaaatcaattttaatttggcccaaatcacacaatggtaagatgacacatgctctgatcagccatatattttcgctttttgtgttacaaggaatcctaattcattatgaaatgggagaattcaaatacctggaaaatagaaactactgaaaaatgctggcagctattttcctgtgattggaacctagaagctggtgatgagttcagatgaaacacttgagtaaagtatctgagtaagcacatactgtttcagaggaaaagagactaactacccttaagaaccaaccttaaggccagagaactagaactgacatggcagccaaatagacagaagaaaccagctagaaacaaaggaaaaggtcatgtcccattaccataaatacttacctccagagctgccatcctcactacttggttgctgtgatagaagaagtttggtaggacatcaaaaatagatgtttctgataggatgagtttctagaagatacaaagacaggcttaagccttacatcaaaaggagaacaatttcaatggacactatttggcatttgaagcatttagtgaaacctaagaattttgtctctgaatgccataatctctctgtgcctcagcttcctgagctacaaaatggagaaaataaaatacctatcctcatagggctgttgtattatatgagtaaatacatgtaaaattcttggaatactgaattaacaatgcattatttgtatgctaatataagtgtttatgactgttattcttttctgacatttatctgaactctctaaatattgtcttcaccaggcatggtggctcacgcctataatcccagcactttaggaggccaaggcgggcagatcacttgaggtcaggagttcgagaccagcctggccaacatggcgaaaccctgtctctgttaaaaatacaaaaattagccaggcgtggtagtgagtgcctgtaatcccagctactctggaggccaaggcacaagaatcgcttgaactcaggaggtggaggctgcagtgagccgagattatgccactgcactccagcctgggcaacagagtgagactctgtctcagaaaaattaaataaaataaatattgtctcaatactccactatggtaaaccctagatttgaactccagttgaaaccctagatttcagctattaaccaaataagaaaaaacatccttttttcccctctagattccccaggaagaaatgttacagaaagtctaaagattcccctgggccagatataacaatggtatccttgtttccaggtagaaaaatataaagtcattcctgagaagataacatttaaaaaataattgcggtggtccttctgattagtagtaaaattagacaataatctcttaaaaacgggcttcttataaagcttaataataagcattaacataaaattaaaattaaatgatacttaaatagctttgtctccagaagagtaacaactacctatgtatacatctgattcaaatatcataaatcatcagagaaatgtgtgtgtgtatatatatatatatatcagaaatcaaccagccttgtcatttaattctggcctagaatactttctaggtaaagtacaaagataaagacttcaataggacacttctatcaaggcaggcctatttgatttttaagctaaaccacaattctaacagcatttgtatgaaaaaaatattcataagtataaatcattttagaaagtcaagatatgaaactccattatatggaaaatcaaaattaattaattaagtgactaattacttaaactatgcttgagaataaaggaggtaagagtccagataggcaggaaagggttatatatatatatatatatatatacctgcaggttctcaatgcaaaattgatgtccatacatgtcaatagctgataggaagatagactctacttggttatggcgaagctcatatgatggcaaatgggaggcaataagaacctagagtgagaacaaaataggaggcacacattcctcggagtgattattctagactcctattaggcagctctgatacaaaagcaataaatataaatctgtaagtgcaggcatcacagataaaacagagaccaagtaaaacaacttctaggtcctgtaacataaagccagtgccaccaaatactgaatctcagttgactctcaccatgatttgcattgtggccaatttcccatggtgggtagggggaagggagagaaaacagcttcgatcaagttccatcagtgtatgtgatttaccattgcaaagctgctggtcctagggactgcatgactagctgttaattgggaatcaggtctggcagggagcagctgtgggaaaggtagatgcagcagagctagccttttacaactctgaagtagaaagaaagactagggaaagctgctttgacagccccaggtactcggcaccaaggagaacgcgtcaggaagtaacaccagagtgtgtgaggggcagagagagtgaaagcagtgtcacaaacaaacaaacagtgacacggtaggatctgaataccctcagcaggtcactgagaggttcaatagctttgagtagttcagtgacatggatacaattgtagagaaagcagaaggtcactgaacagcttcaaatgctgcttccttgtcaatgcccatgcactgaaacacaaagggagtgccaactcttggcttccctgctgaaaccttttggaatggaaatgaagactgcagggtgaaactaactggacttctctggggttgttctgattgctgccgcctaagattcatttcattatctttctgctttccacacttgattatttcctgtacacttggaagttttcatctgcttctaagctccctttgggaagtaagaaatactgagtctattttcttccctgagtgtcctttcctccacctgaccctggtttactatcacagggctactagggagggaagggaatgataccaggattttttaatggggaaagggcttctattttaaagagacgcagcactaatcttttcctttctctttaaaaaaacataccacatgaaaacatttgttctgaggaaaacgtgacacatatatagaaaataacatgttctttgtaaagtgattaagcaaaagttcattgtgtctaggactgcctgatctatgaaagccatccctcctttaagaaaaccaacaaatgtccttacctggcgtgctcgaagtgctactttggcattggtggtcttactgagttgagttagctctgtgagaatattcagcagctcatcagtgagagtagggtcccggccacacaactgatcctaattgttaatgtaaaaaagaacatagatagtcatattaaaaagaacaggtggataggattttaaaatagagaaaaggaatgaaaacaaagtaaacccagctggattaataagaaaatgcaaacttcctattatttttaccctaaacaatgtggtaaagaagatcccagaggaagtttggctaaggagaggcagcccaaatccctcattcaaaattcctaatgtatttccttataaatcaacactatacttttaacacgcagaaggaatcattagagaccactaaaaggggccaaggggattctgagtaagaaataatagatatgtctcaaagttttaagagaaagttttaaacaacagggactaaaggccttcctgtttcccctcccacttttggaaagaaggtagatataaggcaaaaagaaccaccccagtggttttcatctcataaaccaaattttcagcaacccaggaggatgcaaaacagaaacacaagaataaattatttatttataaacacacactaactaaaacaccatctcatatgctggcaattctgcatcccaaatcatttctcttcttcctgtaccaagaatcattccatgatacttaaacatgtgaatccttagctgaattagaggaaaaaaacaggctcctactatagaatccatggtttattcagtattgggtccttcctcttctaagaagtaaaaaatgttaagaaaataatctcaatcatattctgagagaaatatccttactggagtccagtggaatatcagtttattccctaaattcatccattatccatgcaatttccatctaagctgaaaaaaatgtaaatgcagtttttataaatgtctgtcctttttgaactttacagagctactggtagtagtaattattaacaccacaccatataaaatatatccatttagatatcactacctctacttggagttttaaataattgccttggctgggcagggtggctcacacctgtaaccccagcattttgggaggtcaagacaggaggactgcttgagcccaggagttcaagaccagcctaggcaacatggtgagaccccatctctaaaaataaaaaataaaaataaataaaacaaaaaatttttaggccgggcgctgtggctcacgcctgtaatctcagcactttgggaggccgaggcgtgcggatcacgaggtcgagaccatcctggctaacacggtgaaaccccgtctctactaaaaatacaaaaaattagccgggcgtggtggcgggcgcctgtagtcccagctactcaggaggctgaggcaggagaatggcgtgaacccgggaggtggaccttgcagtgagccgagatcgtgccactgcactccagcctgggcaacagagcgagactctgtctcaaaaaaaaaaaaaaaaaaaattttttttaaagaattgcctttgtattttaataaatatttattctccccctactaccaatgggacatgaaagaagacccaaagggcctgcttgttgctgcatgttaatctccccactttgattatcagcccttttcttgaagaatttctatttcatacttaaccttccccatctcagggatactctttatagacctttatcacagaagtataaataaatgcagtataaataaaagacatgctttttccaaaacccctaccttccacatcacaaggtaaatacttttgaaatactcaatgccattatgctgggaaggtttctcaaacccttttttttttttttttttttttgagaaaatgatataatgagattctggttccctaatccaccaatcagaggtctgctctgactgtccagagtcataaaacatatgatgggagttataattaaggaagtgcaagtactgttttcacccatttcacccagataattcactcatctgagtgagaaaaataaaagctgctattaaagtgaagataaacccagaggttctattgaacaggtagcacagattagagaatctgttctacctatcctaggcataaaagcaaacaggagaaaggaaatgcaagtaagtctcaccttttgctgagaactaatgagcaaaacagaatttcaaaggaatatgtaaaactaccagaaacaggaccatagaaagacagaaggaaagaattgacagataacagtaggtagggaaaccaacataattttttcctacctaagtccctttcctaatgttcttaatagagcaaacatactcctttccgaagtacttactaaaagcattggaatgacccaccaaaatgcctaaaaacataagaagtctactgggtaatgccacaactcgactcctctgtacaaagccagactaaagtctcaacattaaaaacaaaagccaacatgacaaaataagagcactagggccaggcgcggtggctcacgcctgtaatcccagcactttgggaggccgaggagggcggatcacgaggtcaggagatcgagaccatcctggagaacacggttgaaacccgtctctactaaaaatacaaaaaaattagccgggcgtggtggcgggtgcctgtagtcccaactactcgggaggctgaggcaggagaatggtgtgaacccgggaggcagagcttgcagtgagccgagatccggccactgcactccagcctgggcaacagagcgagactccgtctcaaaaaaaaaaaaaagcacactaatcacctccgcaacctgtatcagatttgatatagaatgcattccctttaaaagaaatataggtttacctttacagatgaaactaaaatttttaaaaatggagttatcctcttgcatagttacagatcatgttttgttctgttttgttttgtttttaagacggagtctctctctgttccgcaggctggagtgcagtggcgcaatcttggctcactgcaagctccgcctccggggttcacgccattctcctgcctcagcctcccgagtacctgggactacaggcgcccgccaccatgcccggctaattttttgtatttttagtagagatggggtttcaccgtgttaaccaggatggtatcgatctcctgaccttgtgatccacccgcctcggcctcccaaagtgctgggattacaggtgtgagccactgcgcctggcagttacagatcatgctctaacttaaaagacaaaacaaagcaaaacacgtaaaagcacttttttttaaaaaccacttttttattttatctttccactatgagagaaaggcagtaaaaaagggcttcaggagaaaacaacagtatgtgtaagaaaagcgaactatggagattagaaaaaataaatgtgggccaggcgtggtggctcacgcctgtaatcccagcactttgggaggccgaggtgggcggattacctgaggtcagttcgagaccagcctgaccaacatgatgaaaccccatctctactaaatacaaaaaaattagctgggcgtggtggcgcatgcctgtaatcccagctacttgggaggctgaggccagagaattgcccaggaggtggaggttgcagtgagctgagattgcgtcattgcactacagcctgggcaacaagagtgaaattccgtctcaaaataaaataaaataaaataaaattaaaataaataaataaggccgggtgcggtggctcacacctgtaatcccagcattttgggaggccaaggtaggtggatcacctgaggtcaggcgttcgagaccagcctgaccaacatggagaaaccccgtctctactaaaaatacaaaattaactgggtgcagtggtgcatgcctgttatcccagctactcaggaggctgaggcaggagaatcgcttgaacccaggaggcagaggttgtggtgagccaagatcgcgccattgcactccagcctgggcaataagagcgaaactccatctcaaaaaataaataaataaataaataaatagataaataaataaataaatgtgaagtaattatcaaacagtatgaattaaccactattttcgttagtctattctgacttggaagttttccattcaaatattttctccactgtcatcattaatacttagaaaaaaattggcaacagaaaattatgtatagaataacttcctcaaccctgtcttgtccctgacctagacacagcattcaggttctgcaagaaaacatcagggtttttcagaaccacccatcttaagatgccaactaacatccaacaggaagtttattaccctctgtcctagagacaggcttcttttgggcaactggacaaacaaacatcaccatctaatcctggtgaacattttgtaaggatacctttagatggtgtctaggtcagcagatgtgtttagtcaacataaaaaggtttgtttaaagagccaacctgctgattttgggattacaggtcacttgcaaaaatctggcatcccaatccaccaaccaaaggtctgttccaactgtccagagtcataaaacgaagtgaaaattattattcagccatactggtacaaaacagttatttcttgcttttacttttgacctagatggtagctaactataggaaatagttcgaatttgcagaaatacaacaaacatgataaaacgttaaacccatagccaaggctgggcacagtggctcatgcctgtagtcccagcattttgggaggccaagatgggaggccgagaccgtttgagcacagaagtttgacagcagcccaggcaacacagtgagaccacatctttaatttaaaaaaaaaaaaaaaaagcatagccaaagttacacagttgactgacagaagaaaccaacatagtccaacttgatcttagaaggcaattcaaaacgaaaagaatgtgaccttatgtgtaatgccctcaagacattaactattatttagccgggtaggcactaaacccaggatcagcaatgaactggtagcttcttctagtcatatctgcactttttgatatcccaaaaaatgtcatagggtaagtttaacaattgttaatatcacccttattcagtgaatgtggaatcactgagaaagacttttcttctttatttacatattggacaaaattatttgcagtcaggttaagtggaggaaggaaaggtgctgatcagcatcataaattctccccatctaaaccaaatcaggggttcataggcatggcattactcatacagaagcatggtttatagcatgttcatgtggaccgtatcaaaaataagttacaagtagtgaggggaagactacttaccatcaaggtggctagaagatatgtacattgccatctagacagctatgaagatgttgatactttgtatttgtaccaattagcttaatctggctaaagattaaagagttccttaaatatctctaagcaaacataaacaatgttctgagttctaagctttttcctataaagttaaatttaagaaataagaagagctttcaaaaaataaatgtactattggtcttccagactttgtgttaaattgtgttacaatgtccctttaaatggaggaaacctgataggactttagccttttacctgatactttgctttccagacagagtgaaagattaccagaaatctgcttgagagtccatgaggcaagttaccactgggcaggttatgctaacacctggagaggatgaaggtacctctttactagagcaacgcatatcccatgacattgactcacggaagcctgagtttcttgatacctccctccctgtaggttcaaaagccccagaaatcatcatctagctcagcaaagcatactatcaacattcctacttctagaaagcagagaatggaatactgggcacataaccatcaatcaggaagccaagatatgcaaagaaaggggaaccagcagagaacacaagctgggggagtcaaagtgctaccatgtgcaggtgacatctgtaaaagatactaagatccgaggaaagaataatccaaacaaccaaaatggctcttaccagctactaccattaatgcagatgtgggagaggaggagggagaggaagaaggaagggggagcagctaagcgttgtcaaagaggaaaagaggaagacatgtctggcattcagtaacatcagatcagaaaagagcaccgtcttgagcttttacccatgttccataagtcactgctagctggccctgagcttgatcatatcattaacttcttgatttccaaatctctaagatgaaatgaaaacaactgatatttgaaaagaaattaatgacatgaaagcttagagatcctcttatgtttactgggtctcattttgtttttgttttttttttaaagaaaaatgtaatgacaccaaaataaagaaagggacaaatctggcttcctggttcacatgttcaaccgtccttatcctcctcctcctcctcctcctcttcccatcccccttgtcctcctcctcctccatcctattcacccaaactcaaactctgaaacagctcttttccctaaagagctcagcctgttggaaagaaagtctgggtactatccatgcaggtaagaagtaatcaggatgacaaggtgggagaaaaaaagaacagcgtggaaagtcagagtcccattggcttctgcctgtcctgactggcaaaagcagaaagcaaagcctcaaaccagttctctgacagggcccaacgcctctgcagcaccccccgcgtaattacacacttgagtgactggactctgaagaaaattgaaggcctgagctccgaacagctgccattttctctctccatcacaccagcgtgattacttgagaaatgaacagccctggctcaaagctactccagaattctcagaggaaatatggctccgtgttccaataatgagattcttaaggcaagcgttacttacaatcactccgcaaaaggagcgagctgagcccctatatcttacaaattagaatttaagaaacccagcgacagtcttggacaatcattactcttccgctgctccaaggattctaggctttggtctatttttagtgcagaaaactgttaagttcttaaaaacgtaatcacaataaaaagaaaaactcaccataattagcttcctataaaggcaaattccaccccattctaggtccaaactgacagattctcctaccctcctcatcattacccttttctgacagaaagtcttggctttatccaaatgagatttaacaatcctttcattaaattaaaaaaaacatctaaatagtctttcttccttcttttgactgacaaaaaaaattagcaagctgccatagattgtatcatttcttagctgaaacctgtcacttgggggaagttgaagtattacattgtactaacatatatatttttccctctcaactgcatctttctcgtttccctaccatctagctattctagggtagcaaaggcaatgaactctccctataattacatattttttaaagtggctattctaaaaaatgtgatacgctttagagttaaccagctaggcatataactgaatgagtggcactcttgttaatcagaggtgtatggtagatagtttcccttcattctgaagaaataaaaaatagcatgaagatgtatgtttttttcctccatgaaaaaatgatgtaattaacttaccaagaatcccaattccacaaagagacaaaaagaaaactctaggagtgaaaaggcactacagtccccaaaaagacaggcatgcagcagcaaggcaaatgctcaggaccatggggtgagggactctaggagtagtcctactgtactaattcctacaactaactcaaccagaatgagctaggagtgaaggacttgcaagtcatctttaaaaatccttcagcccacaaaaattccacccactggctgaatgcacattagctctcatcaaacttaccaggctcactccctattcctacttcctactaattcttattttactaagttatagggaaaaaaatcatacatttactaccaatacaataatccgagcttagattttcaatgtaaataaaaagggaccaatgaagatgcagaatacatttaaatttctctggtcagagagggggagtgctggatttctatttattttttttcaagtttgacatgagagccattgcttgtatctatggaacaagagttaaaattagaatatattggctaaataagatgaaattttaaagctgctgtcatgatgaccacaggaatggtgaagcacgaggcatttctaaacagagttaggaggtataagttcctgtgaatgagtatatgcataatggccagaagagtcattttctcactaaagcaggttccttcagaccaaggacaaaggtagacgtgagaaactgttaatccacagctcaagccccattcatcccataattataaaaggcagtagttttttttctctggccatagccatcaaaaggaaaaaaatactttttgcatatcattgacggtctttacaagttctgaaaaatggtactcacaataagcattgtgaccagaagattcttcttggtgacttgagcgtgagagaagatgtagttcagtacagtgttcatgtcacttttattctcttctcggagggcgaatacacatttgtcatagtgacctgcacaccatgaaaagaactggttctcacccatgtataaatgttcacatttacatgctatttgttttgtactgtctataatttatgagacgagcagtgagaagaaacatcataaggattttcttggatggatttgtacagaaactggcaatgtgatttagtaaaaggaacactggactaggagtcaggcaatttggatataagatctgggttcaaggcctagttctattagcaatttactgtgtgctcctgggaaaatcattttacctctctgggcctcaatttcattaaattttttaaaaattggggaggtgggtgtaccttaaagactgaaagattgggaataactcaaaccccagtcttactctaaactctctcatgatttctttagacgagaaatttctgtttaaaaagaaatgtaaatatcattaaacttgatgatctttaaggtctcccccagagcttgagattctgattccatgtttgacttgcagaaaatagttgaccctaatcagtaggaacagttttagctcaaaaaataaaaccacaccaaacttagcaatatccatgagaagtgtgactgctacccctggaatcaacattttcttctgttagtccttgaaacagctaagcaatgcctaggaacgccaaatccaacccaaggtatagatcaaggagaaccttgcattaagtcaaaaggtctgtagggagactaaagttatgcatattttcacttgccttccctaaggccaccaggggcaggttagttctgagtaggaaagctatgttttacaacagaagcataagcctctggtacactgtagtgatatctgccatgggatataagtaatattcagttctttagaaaacagcttacctcagaattaaatttccaagtaaagaggaattagtgtttgaatattctcaagggtcagaattttatgaaatcatgaaaacagtaaaggattatcacctcagttcagattccacgttaagttacaaaccagaacagtgacgttcaaactgcattatcatggtttcctagaacactgagtacactggaccagtgtaaccaggcttttaattattctaaatattagagattgacataagcaatttttttccaaataaaattatatttgaaaaacaatggactacaatatcgagagagctgccaatttcataaaagacacatttagaccaaaagggaagctgtttaaaaattagctgttctgcattaatatttttctctaccaagacttagctttgaagtgacaacacaaataaactttggcaataggaccaggggaaataaaaagaacacatttacccggggtgaggggagacattaacagaaagaaagcaatgatactttcttgttttttttttttttactttgaagatcctgcataccaagacactcttttttaaaaacacttaattggctgggtgcggtggctcacccttgtaatcccagcactttgggcagccaaggcgggtggatcacttgaggtcagacatttgagaccaggctggccaacagggtgaaaccccatctctactaaaaatacaaaaattagccaggcatggtggtacacacctataatcccagctacacagcaggctgaggcagaagaattgcttgaacccaggaggcagaagttgcagtgagcagagattgcaccactgcactccagcttgggtgtcagagtgagacttcatctcaacaaaaaaagaacacacaccaaacaaaaaacaaaacaaaacagtttaattatgaaatatatatacagaagaatatatagaatatatggtatcagttgaaataaacacccatgtgttattttaaagccattacattttaatagaacatctctagtatctttgaagacccctgcgtacccctcctcagaaacaactactaagctgaattttatgttaattattcttttgtttttcttaacttttatcaccaatgtatgtatagcttaattttcctggtttttgaacctgaaaaaaatggaatcactgtaccatttcttttccttaacattgtatttttgagattcatccttttgttcagtgtatgccttggtgcatccattttcactgctgcatagtaatccatggtaggaatataccagacttcaatgatccactctacctatgtatatttagattgtttcttgtcttttttaagattatgaacagtgctgtcacaaatactcctgtatatgtatcctagtaaacatgtgtaatagtttctctaaagtatattttctaggagtaaaattactaggttaaagaatacaaataagttcaactttattaggtactgaccaactgttaccaaagtggtatataccaatttgtacttccatgtacagaagcaatgaagatgatgatgtgacttttaaatttttgccactctcattgtggttttggtttatatgcctctaattacaaatgggattgagcatctttgtgtaagtttataaattatttgtacttcttcttctgtaaaatatctttctatatcttttgcccatttctctattaggatgtctttaacttgatgattcataccaattctctagatacttctaattattttttaggtatatattttgtaaatatcttctcacactttgtagcttatattttcagtctctttttttggagactgtgtcctgctctgtcaacggggctggagtgcagtgatgcaatcacagctcactacagcctcgacctccccaggctcaggcaatcctccaacctgagcctcccaagaagctaggactacaggcacataacactacacctggctaatttttgtatttttttagagacggggtcttgctatgttgcccaggctggtctcgaactcctgggctcaagcaatctgccggccttggcctccgaaagtgctaggattacaggcttttcagactccttatgacgtattttgatgaacagaagttcttgagtggagtttaagtaatcaatcttttcttttgtagtttgtacttgctgtgtcttatacaacaaaatcttcctatcctgaggttataacgatattctcctaaccatttaacagcttcacctctttagtacatatttaagtctttatcgggaattgatttttgtgtataggcataagatagggattccatttctttctttcctctttttttttttttaaatgaataacccattgtgctggtatcatttattgaaaaaaaaaaaaatctatcctttccccatgatctacaatgcctcctctatcataaaataagttttcatatatggctggatctgtttctgggtcattaagttccactgatctataaatctatctctacacctatctcacaatttcttaattaatatggctttatattaaatcttgatatctgattaggcaaatcttttcaccttgtatttctttggaagtatcttggttattgtgagacttgtcttttatggaaattttataattagcattacaaatacactaacagaatttttattgaaatgtcaatctacagatgaatttaggaagaatcggcacctaatagtgtacattccaatttaagaccttgataatttatttaaatcttctttactattataatattcttgattataattttcctcaaaagaggcttgcacattttttgttagatttactccttagtatttcatgttttgggttgctattttatcaactaattaattaattatttagagacagggtcttgctctgttgcctgggctgagtgcagtggtacaatcatagctcactgcacccttgaatccctgggctcaggcaatcctcttgtttcagcctcttgagtaggtaggactataggcatgtgccatcatgcctggctaattgtttttaattttttgtagagatggggtctcactatattgccaaggctggtctcaaactcctggcctcaagcaatcctcctgtcctggcctcccaaagtgctaagatgacaagcatgagccactacatctagcctgctattttaattttttttttcctgaactgcttttctaaacaattgctctactgtaaacaaatactgttgaattttgtatgttgacttttgtatttagcaatcatgttagattttaaataatttaataatcaatctgtgaatcctttgaggctttctaaagagacaccctatcatatttaataatggcagatatattgctttattactttctagctcttataccctttaattcttttccttgtcttactgcactggctaggacatccactataaagctgaatagaagtagtgacagcaggcatccttgtcttattcctaatcttaaagataatgttttcaacgttttaccataatgcatgatgtatcctgcagatttttttgtgggtcccttttacaagattttaaaagttccatttcactcctagtttccaagagtttgtcatgaatggatgttaaattctgtcaaatgctccctctccacaccctgttatcttgagataatgagcatgtttttcctcctttcatctatttcatgataaattatattaattgactttctccaaactgatcaaccttgaatgcgtgggataaagccaacttggttgttatgtattattttgtatgttattggatgcggtttgctgatatctacatgaggatttttgctggtcatgagtggcataggctgcttttaaaggaagtgaaaaggagcagataaaggaaaatgtttcaaatttcagataatgtttcaaattctgtgatgtttcactgccatcttgtggcaggaagcaatgtcagcagtaaacagctttaaaattttagccaaggttatttcacacttaagagacaatttatcatttagtgaagctcttcagagaaagccagggataaagtctacctaaatgatatactaaaaagtattggaaaacctgaacttgctcttcctagatgcctctggttcaattcatggattagctgccaagaatcaagctcttcagatatgggtttctcaatttcagcctgtgatgactcaaccaacttacactacacaaggtcaaaaagatatcaacaggaatggtaatctctattagaaaaattacttcagccctttctcagaagcacactggattcctaatttcatcaagctgtgtttcgttgttctttctttagagctagtggatatagaggtttagtttttaagggagtagtgataggagactgtttattaatgggaagtgttgttgacaggagggggcttagctcttacacagtcctatagggatagtttgggttggttatcagaatcaaggctttcttagctagagagtcctcaggaagaggcttaccattctggaattgtgtctctactcgcaggtactgccggagcagatccatcaccacagccttcatgtggcctcggatgccacttcggtacctaggcaaatagaaagtctccactgaaaaacctgacaatccaacactattaagcaataaacccaaaggccaaatttacctccacgacattccactgaactgctttccctctgaataaagaacagcctaaaatgaactacaaaattaacttaaattctaagcctaaaagaaatctcactatagacaagaccttttttaataaagaagacaacaaaatcctgcatagccccacctaccaacaccttgattcagttcctactgctaagtagaaattattaccatactcttgaaatggctgagatatctgaaaaatttataagtatcttaaagttaaaagtgttctgtgaggccggttgccttagctcacatctgcaatcccagaactttgggaggccaaggcaggaggatcacttgagtctaggagctccagaccagcctaggcaatatggcaaaacctcttatctacaaaaaatacaaaaaaattagccaagcatggtagcatgtgactgtagtcccagctactcaagaggctgaggtgggaggattgcttgagcctgggaggcagaggttgcagtgagctgagattgtgctactgtactacaacctggatgacagtgtgagaccctgtctccaaaaaaaataaataaataaataaataaataaatatgctctgtgaatatccctttagtattaatagcaacaaccacaattacttttgcaccaacctaatataataggctccataagctaagaagaaaaaatgtcatactgggccctgtgacagaagaaaaattaggagcttcatcaaaatggcaaggaaaaagaaaacaacaaaatttctgtgccttattaattgacaggctggacgcagtggctcatgcctgtaatcccaacagtttgggaggccgaggcgggtgggtcatttgagcccaagagtttgagatgagcctgggcaacatggcaaaaccccagctcttctaaaaatacaaaaattagctggatgtggtggtgcacagctatagtcccagctattcagaggggttgaaacaggaggatcacctgagcctcaggaggttgaggctgcaatgagccatgattgagccactgcactccagtcggggcaacagagtgagatcctgtctcaaaaaataataataataataaataattgacagaaaaaaatgtagaatattaagaagtcagaaatattgagcatgagagttagctcacaattctaagatatttagaaaagacaaggtactttctaagatataagatgctttccaatttcttgaagtcaaatctgaggtaaatttttttgtgaccacttgaaagaaaggaagacatgagtatggacaggtctgggaatctggagttacaagttactacctctgtaccagctgaacaatgctctgagtattcataaagaagacttcccgttcagatttccggttcaatgtagctgcatggctatctaggatgtttgcaatctaaggtataaaaaagggaaaaaaatgaggcccaacccaacaaaatgccccaaagcatcagcctctatagcacgaccagtaggaatcttcttcttataacatggcagttcctatctcacatgttggcagcagctggaagttaccaggcgtagtctatatagagaatcacgctacataagcaagcagatttcatcccttgtcaccctttcccagatgaattaatgactacattacaaaaactatcatcttaccaatatctgttcaaggtcaagatccaaacatcactccccacttatctacctatattccctacacatacatctgctttatgggtaaagagtaaagatgctgccaaggtagtaagaatgtctctgaaaataaaactaccaataggccatgtgtggtggctcacacctgtaacctcagcactttgggaggccaaggagggaggatagcttgagcccatgagttcaataccaacctgggcaacataacgagacccccatctctataaaaattttttaaaaattagctgggcatagtggtgcacatctgtagtcccagctacctgggagactgaggtgggatgagccattgggcctatggggtcaaggctacagcgagccatgaccgcaccactgcactccagccttggcgacagagcaagaccctgtctcaaaaataaataaataaataaataaacagctgggcatggtggctcacgcctgtaatcccagcactttgggaggccgaggtgggcggatcacgaggtcaggagatcgagaccatcctggccaacatggtgaaacccgtgactactaaaaatgcaaaaattagctggcatggcagcgtgtgaatgtaatcccagctactcaggaggctgaggcaggagaattgcttgaactcgggaggcagaggttgcagtgagccgagatcagccactgcactccagcctggtgacagagctagactccatctctaaatcaatgagtgaatgaatgaatcaatcaatcaactaatatcactctattttcaattcatgaaaatacctctaattagggaatagccccaggaacaaagctataaggtatacatgatccaagtgtgcttttctcataactacagatacttatccttcacatacagtactttcactgttgggtttgtaccctgaggcagttttgtgaggaatacaatgcttaaaagtatacaagcacaacatccaaaaagtaaggaggatccaaataggaaggaatcctacaacataaactctggcattggtagccagaaaaaaatatagtgttatcctataaatacctgctggctgggaaactgacagaggactgatgtgatgttgctagcatactgagccatttccttcttgatagacttctccacattggggggaatgcggccagacacactggtcataatatcttgcaattctaggagaggcagggagggatctctgagggttttcatcaatcgctctacccagtcttttacctagaaagaaagcattggtaaaataggacccaagttaacacaatcccccaaataaaaagatatatagttgtcattctgtatacgtgggaaattggttccagaaccaccactcatatatgaaaatctgcacatacttgagccctacggaacccatgtatagaaatagttgtgggttccatatctcatcaatactgtaattttgatccatgtttggctgaaaaaatccacatataagtggacccacacagttcaaacctgtattgttcaagagtcaactatatctgaattcactatcatatactacttcttttcaataaaaatttatataattttcaatagatatggggtcttgctatgttgatcaggctggtctcaaactcctggcctcaagcgatctttccatctcagcttcccaaagtggtgagattacaggcgtgagccaactatcatagagtactttgaaattgcaacgtaagcatctaacattgcccctattctccagtttaaaaaggactaatcacgggtgggcacagtggctcacgcctataatcccagcactttgggaggccgaggcgggcagatcacaaagtcaggagttcaagaccagtctggccaacgtggtgaaaccccacctctactaaaaaaaaaaaaaaaaaattagccgcgcctggtggcacgtgcctacaatccccactactcaggaggttgaggcaggagaatcacttgaacccaggaggtggaggttgcagtcagctgagtttgtgccattgcactccagcctgggcaacagagcaagactccgtctcgaggaaaaaaaaaaaggagtaaccacaattaaatgtgaagtccatgacaaggataagaaacatggatttaaagacctcaagtcccacaactgaaggtgaaagagttctaggccaaacagctttcttttcctccctcttaaacaatcattatgagacttggaactattttggagaataggtatcccatttgtacatcccttccccaggagacgtgatacataccttgctgctaaagaaaggatctggaaggcagtatccattcattacattgaccagattatccaggacataatggaacactcgatggagtttctcgcctctgagtgccgtgctctggatccgtggcagactacctgtgtgaagttcagcctgtcaaccccaacaagagatcaagtcatctactacttttgatctaaggtacaaacacaccactgcacttaagagttatcattcaaaatcgagacatcatacccagctaccaggagggaagtcaatagaggaaacatcataaggaaattacagaatcttagtactacagtaactcttgcaaactctagttccataatactacaggcacaaatacaaggcataagattaataggggacaaagctaaagaaaacactggcaaaccaagcattgaaatcacttgcctctccaaaccaccaagttctttagctcttagagagcaatattcggagcaccttcctactcacctgctgaaccttgctggggttgtccagttgcattttggctagtacacagccagggtcaagagctgctccaggtcgcttgacgtaatggatacagccagactccacagctgttaaggtcattaccatcttcattacctatagtgaaaaataaactagactcagatttatctctctttacacagatgagtgcttaaaagaactaaaatttttcccttagcatctaagttggaccacacctaatttgaccaagaaaaaatgggaatttaccatcatctcctagggactatcaaggcaagcaattagaaaatctctcagtacctcactttaggaattaataacagttattgacatttctcctttctaacttttacaaccattttggcataatttgtgattatatttgttttgtacttagaaagtaaggaacaatttaatatcctcataccagtgaatccaatctaagacaaccaggccaaaacctaaggatcattcttcactcctctttctcccttacctaccaattaccaacccagccagacatatcttctaaacctttctcaaaaatcttcctctcttgccatctcttcggtttacgccttcttcatttctggcccaaagtacttcaaagaccccctaagagatctccctacttgctacatacctccctcaaggtcacgaaaagcaatcttcctagaccccaaatctcatcatactacttttccacttaaatctttcagagattacctgctgcctccaggatagtgaaaacttactagtatggtttataagatccttcataacctcacattcaagatctcacattacttctttagcacctttgcttgtccctccccattaaaccttagtctattctcaagccacaccaacacatacttgcagttccctaaatacactgtgctgtcttgcttctgtctttgtacatgctattccttcaactttaagcactcttccctgcccttcttcacctgctctatcactatctgtctttcaaaactaagatcaaatgtctcttctttcagaatatcttcccatacaagcttagcttgatttgggttaggtgaccctctgcactctatgcttagctctcttaaaattaatcacatgacatttcttgtctgttttgtgccccacctccatgtattttctctggatagccagcagttaggacacctaacattcaacaagtgctattgcctagtatctatttttagaactagagattcctcatttgcctatgtgttttaaaaatcttaaggttcgcacttctaattaagccaactgatgtttctttttcattcttatttccaatctgttacctttttttttaattttttagaaatagggtcttgatttgtgacgcaggccacaaattgtaccactccagtacagtggtacaatctccattcactgctgccttgaattcctgggctcaagggatcctcccgccttagacaccagagtggctgggtctacaggcatgtgccactgtacgccgctaattttttaatttttcatagagatggggtctcaccatcttgcccaggctagtctcgaactcctgggctcaagcgatcttcctgcctcagcctcccaaagtggtaggattacaggcacaagccactgtgcccagcctcctttctgtaacttttcagtcctagtccatcccagccgacccttttcctaccttcccctcccatgatcccacagtcctttcaccaccctgacctcaatctcagcatagcactggccggcaaacacatgacctccatcttctacaatgtactggattaacttcccagcagaaggtgagcgcatcaccgatgggtcattttccttctcaaacacacaggttttattgccaattgtgatgcgatatctaggagacaagtggaagtatgtaagctaagaaagcacctcaggatgtaaaggagaatggtagagaatgtcaaccttcaaagaaaaaaaatcctgaaaactttattatacacacacacagacatattcactgcatatttgtttacaatgtcaattaacataaatttccttcaataaggatcagattaaatatagtataatcatataatggaataccacatgactattaaaaataacaggtaccaccatttaaaaaaacacacacaaagatattgatgacgtaatagctaacatttcttgaagcctagctatgttgtggcaatgttctacacattttcaacatgttaatttatttcattctcataacaccataactggtgttgaacatttgtgaatttcttttttttttttttttttgatacggagttttgctcttgttgcccagactggagtgcaatggcgtgatctcggctcaccgcaacctccacctcccaggttcacgtgattctcctgcctctgcctcccaagtagctgggactacaggcataagccaccacatctggttaattttgtatttttagtagagacagggtttcaccacattggccacaccggtcttgaactcccagcctcaggtgatccacctgcctcggcctcccaaagtgctgggattacaggcgtgagccaccgcgcccagccacatttgtgaatgtatttaaagaaaaacagtatgtacatgagtgtaacttgtatatgcatataaaatttctactcaaatatgtaagaaacttttaacaatggttacttataaaaaggggaacttatttttcattgtccacatacactggagtggtagggagacatgtttttaattataaacactttaatactcttgatatttttgttaagtgcatgtactattttttttttttttaactacaaatgagtaccaagaaaagcctgggaaaatcccaagagctagtagctaataagagaaaaggctaacaggatgaccagcaaatggacctcaaacagccacttacctatccacttcctctttcatatacgtagtataactgctgccatcataggacaagagcagtccaccgtcactcagccgatgtacatctacttctacacatgagccattcatgatcaccacataggagttgggggactgtcgagtcacctgtagggaatgagaatgaggatcagtgtgtcccttccaggtacagctccaaatgaaatttgaatgcttcaaaaatacagataagaaagatctgtcaggaggaagaaaattcatggcactgatgctatttgcatcagtgtctgtggacatggctcagtcctgctgtaagcaaagagggcaaccttagttgattttccccaactgtggttgttccctgtctctcctttatctcttggcagtgtatgtgaagttgaagaacaacaaaaaagattttcatagaacaacaaacgctgcttcaggacactgacaaaaataatgacggtaatttcactaatacccccatccctgcattaaatcaaactttttctcctgcctctcaacctaaagaaagatagctaaaaaagtaaggtgcaagctccaatggggttctgcataccttaagtacatacttgactccctcatagataagttcaacatctactgtattcagaagtgtatgagcaggaaggacttgacccctgaaagaacgatgagagaggaacttactacaaagttctaacagttataagagaatctaaaacattattgattgtagcatttcctagaataacaaaagactagaaacaacctaaatacctaaatgatcgtttgtaaggaattgatcacatcaattatgaatcttacaatggatttttttaaattagggtaaaatacacattacattaaatttgccatcttaaccattacaaaatgcacagttctatagtgttggggatattaacactattctgcaaccaatctgcaggactttttcaactggcaaaagtgaaactctacacccattaacaactcccaatttcgccctccccccagttcctggtaaccgtcattctactttctagttctatgagtctgactactcttcatacttcatataagtaaaaccatatagtatttgtctttttgtgacaggcttaattcacttgccctaatgtccttaagatccacctatgttttagcatgtgtcagaatttccttcttctttaaggctgaataatactgtattgtatgtatatgccacattttgtttatccagtcatccatcaaccaacatctgagttgctcccatcttttagctactgtgaataatcctcctatgaatgtggctgtgcaagtatctttcagaccctgctttcaattctttcagaatacccagaagtggtattaccagatcatagggtaattctatttttaattttttcagtaattgcaataccatttttcaatagtggctgcatcattttacattcccatcaagagtgcacaagtgtcccaatttctctacgtacttgccaatacttgctattttctgttttttgacagtgggcatcctaatgggtgtgaggtggtatctcatcatggttttgattttatttacttaatgattagtgatgttgcgcatgttttcacatgtggaacaaaacatacagacattaaaaagatgtgaactaaaaaacactttaaaaaatatactgttgagttaaaaaagcaaggtaaataacagcttcacagcatgctaccatttgagttttaaaaaaccaggaggtgggaagaaacaaatattgcatgttgatatggttcggctgtgttcccactcaaatctcatcttgaactgtagctcccataattctcttgtggtgtgggacggacccagtgggagatacttgaatcatgggggcggttcccccatactgttctcatggtagtgaataagtctcacgagagctgatcattttataaggggaaacccctttcacttggctctcattttctctcttggctgccaccacgaaagatgtgtctttgctcttcctttgccttccgccatgattgtgaggcctccccagccatctggaactgtgactcaattaaacttctttcctttataaattagccagtcttgggaatgtctttattagcagtgtgagaacagactaatacacatatatatgttcatgtaagtttagggtatctttggaaggttagaaaagaaattggtaatatgaatttactataggggacggaaactggatggccaaggaacagaggtaagagagagacttctcactgcttatcttttttgtgccttttgaattttgaaccacatgaatgtgttaactgttcttaaagataaagattaaggttgggcgcagtggctcacgcctctaattccagctatttgggaggccaaagcaggcagatcacgaggtcaagagatcgagaccatcctggccaacatgttgaaactccgtctctactaaaaatacaaaaatgagctgggcgtggtggtgcgtgcctgtagtcccagctactcatgtggctgaggcaggagaatcccttgaacccaggaggcgaaggttacagtgagcagagatcacgccactgcactccagcctggtgacagagcaaggctccatctcaaaaaaaaagattaagattaaacgcgaaaaaattataaaacttcagtgtaagcatatctgctcctagcaactgaaactttatttgagagtctttaaaaaggccgggcagccgggcacggtggctcacgcctgtaatcccagcactttgggaggccaaggcgggtggatcacaaggtcaggagattgagaccatcctggctaacacggtgaaaccctgtctctaataaaaatacaaaaaaaattagccgggcctggtggcaggtgcctgtagtcccagctactcgagaggctgaggcaggagaatggcgtgaacccgagaggcggaccttgcagcgagccgagattgcgccactgcactccagcctgggcatcagtgcgagactctgtctcaaagataaaaaaaataaaaataataaaataagtaaaaaacaaaagcattttaaaaggaggtgggtggggggcttgtagaggaaaatgcatttgacatatttgtacaccaataagaaaactatttaactaggttacagattatatgttgcagaacagaaataaataagactggattggtaaaaagcggcccatgtatacagggagttgaaagtcacgccaagggatttagatttgatacagaagagaaatgccaagctgctgaaggttttactacatgagagtaacatagtgaaagatacttatcataggacttgaataactctgaaatctcagttcaatttttaaattttgtttcttttctttctttcagatacctcaaaagggagttgatataagtctaacaacacagaaggaaataaaagtgcctgtgattaaagtgctttaaaatgattagccacttggaacattcctctggggactcaaaggcagagcttagtctcctcaatcagcaatagaaattagtttagccccatagatgtctgaccctctacttgaaagactcatgaggtcatcctgaatatcagccttaattatttacttctgaaaggtggtacaagtaatacatgaaatatttagggttcagtgctagggagaaataccagatttttatcaccagggtttggagagatttgatacttatacaggacagaatatctactgcagatggattccagtttttaaagaagcaacctgttctaactgtggtataagttaatgtctagaatctgcagtttgactccccaaataatttgccataaatgtcaacatcccctctctttcttgccaccatggtccatgaataacaagtagcactcataagctgccaggaatggacagaagaataaatgggtctttgagcttcagtccctgtactcagggccattgattagtttgtgtagcctacaagaaacaaagcctacctttctaaggagtgaaggaagttagagacgctattccgcaggctcacatctgccacgtggagggcaccacacacaacccccaacatggtgtcaggtcgctcagcctgaaaggaggaaaaagagggcagatcaaatgcatggtcacttggcaccacagcctctcaaatgaaatcaggctcaaatttgttgtgatgaaacagctagcaatgaaaatctccattctcactgcccaactgattttttagataaaaatgaacacattcacttttagaatttgattagaggcaccacttgaagagaaatgaaaaacaactttcttcttttctccctaagacttccacttagccaatcattgaatagctcaaaaataggcttctgacagaaataaatttaaaaagacacaacgatttggctactgataatctcaaagaaaaacggtgtatagccaaaatttggacctccaaattatatgaatctaacgattttatacaaaatcttggataatttagcatagccccaggaattaaggaataagtgataactcttgatctaaatgaggcctctctcttcagcatctggtagatacagaagttggcaactatggaccaggtttaacattaaatgaagaaaaagaaagtaattaaatccctgcatgcctcacttcaaatatacctcaggaagtaatgctagaacataaaatgactgtgtgacacaagcacaggaaccatcagagtgctaaaattacactgactcctagatttttccaggtagatcaagaaccatttacattagaatcaaataaatttcatgtagtggcagggattgagtacacaagtctataaaaacccaatcccagcatctgtttgtggagaaatacacacctgtactttttctgctatcagtctgtccagccagccagtatcaattctgttcatctgaaagctttcagtctctaacaatttgatcaggtattcaactgtagttcgaaagtcaccccgaatagacagctccttcaaagccaccaccatgtttctgggagaacagaagccaatctgtttcagcaacaaacactttaatgtttttcaataattttaaagatctgtttggccaggcatggtggctcacgcctgtaatcctaacactttgggaggccaagacaaggcggatcacgaagtcaggagattgagaccatcctggctaacacggtgagaccctgtctctactaaaaatacaaaaaattagccaggcgtggtggcgggcgcctgtagtcccagctactcgggaggctgaggcaggagaatggcgtgaacccgggaggcggagcttgcagtgagcagagatcacgccactgcactctagcctgggcgacagagcgagactctgtccccccaaaaaaataaaaataaaaataaaagaaagaactgtttcattcctttggaatcttgagagggaagggagagaggcagttccaaaaacaaataagggtgcacatgtcaagtgtgctcattcatgtgcattcaagagagggaaatttgcaaaaagtcagaaaacgtatgaattctaactgatattaccataagagcatcagcaaatcagaaacatttcattataatgagtacagaacaaattataacaaattatatgcaagtcaccctcagcttttacttactaagtttccattattccattcatttgttgttggctaacaagaattagggcattaattctccctatccttgtaccttatttattttatgtataatttacatacaataaaatatacttattttaagtatacagttcaatgaattttcccaagtgcttaatttaaagatttccatacagtaaagcaactctctgggtgcagtcatatatcagcctgacactgcatgtgacagtgttttttttaaaactgcattttggatatctatgcaatgatttgctcattacttttattacttcccagttaagtgcaaagtgatccaattttagcagaatttcaaatactatggggcttttctgtatatttatgcccagtgtctatcctgcatgggacaggtacttacttccacaaatactaattatgtacctcatactaataagacacatactatgattgtaaggaagaacataaatacaataatcactttcaaaatatatggcagaatatcatcaatgccagacagaatacttacacaaagttctggagaggttgtaagaagggagaaattcatctccctacagtttcatgaaaaatgtggaaactgacatgggctaaagtatagctgataattataactgtgagaggaatcatattccaggtagtccaggcattccctcagcctaaaatattattctgttgcccacctctgtcctcctttctgtgtcctcctttgacctgacttacttctacaaacttcaattatcaatctagatgtcactgtcttctgggataccttcccagaacccctctagactgagttagttgactcatctgtatgatcctataatgcccttaaataatctgactatcatcatacttaatacattgtattttaactgccaattgtcttacaccctctggattgtaaagttttgtgaggagagagattctatcttggacctcactgtattgccagaaccagtagatagcagatactcagtaaatatttgttgaatacaatgaatgaatgggcctggcacagtggctcacacctgttatcccagcactttgggaggccgagttgggcagatcactcgaggtcaggaattcgagaccagcctggccgacatggtgaaacccgtctctactacaaatacaaaaactagctgggtgtggtggcgggcactccatgtcagaaaaaaaaaaaaaagaataaatgaatgaacagaggaaatagcaagaacaaagaagcagagggaagaaaatacaggttgacaaaattagccaggcatggtggcacgtgcctgtaatcccagttactcaggaagctgaggcaggagaatcacttgaacccaggaggaagaggttgcagtgagctgagatcgtgccactgcactccagcttgggcgacagagcaagactctgtctcaaaaaaaaaaaaggaaaatacagcttgagttcagggaatggtatgattgaagcagaggtataaggataggaatgagtggctaatccattcaaccaacgtttactgaatgcttactatgttcaggggatatagcagcaacaagacacagtcctgttctcatggtatttagattatgacccatgggaaattatactggaatatactggaatatatgagttggggcattctggcaaacaagagtccaaaccccaagctgagatatagacctaatgaaatgaagaaataagaaacaaagaaagctctaagctgaagaatgaacttttggcatagtgtcaagaaggagacttattgtagataacgtatttttaacatgctaaaaattaagctagttagctttgtactgtagacaaatgtacagagctggtcagaaataaggaacaaggcttctggattgggttataggacattccctgaagaaaatacacagtggtctgccaaatcaggacttaaacctaaatgccaacagaggccagtctgggaacataaatgagtgaggcagactgaataggagctgtgttaactacaaagtttatgtcccgtcgaaaagaagcagtcacacaaaactagctgttttttgtttgtttgtttgttttttgtttttttgagacggagttttgctcttgttgcccaggctggagtgcaatggcgtgatcttggctcactgcaacctcagcctcctgggttccagtgattctcctgcctcagcttcccgagtagctgggattacaggcagttgccaccacacctggctaatttttgtatttttagcagagacggggttttaccatgttggcgaagttggtctcaaactcctgaccttaagtgatctgccagcctcggtctcccaaagtgctgtgattacaggtgtgagccaccgtgcccaggcaaaattagctaacttttaacaactagaatgtacaaccaatgttgtcattatagtcctacttttaagagctagcagaaatccatattttgatttcaatctcctgattttttaatattgtcaaattaaaaaaaattaacactttgtgagcccatcaaaacacatctgtatgttgagactcaccagaaagccaacaatttgcaagctctagtgtaaacctttttcactttgcagagcataatatggcagcgaatatgcttaaaaggcaacttcataccaatgtttttttctggtagcagtgttttaattttgaaaaattccacttatagttttgaagaatgagaagaaatgtaaaggacaaaatagagaaataatgagatttccctacttctaaaaataatattaaaaactaattaatcaaggctgggtgcagcggctcatgcctataataccagcactttgtggggccattagagcccaggagtttaagactagcctgggcaacaaagggagaccccatctctacaaaaaatttaaaatttgctggacatgatggtgcacacctgcagtcccagcaattcaagaggctgaggcaaaaggattgcttgagcccaggaggtcgaggtttcagtgagctatgatggcaccactgcattccagcctgggtgacagagcaagactctgcctcttaaaattaattaattcaggaaattgataaaaatataaaactaatcaataagtgtttattaatacaaacaaccatatattaggattaattactaataaacaaatgctatttattagtaattaatactaataaacacttattaattacctactccatgtacagtacaaaggtaaagggaatggtattaaatgtttgatacaaggcaataaaccattaaaaaacagaaaagaactagttcaagtttcaattttagatagatattccaaaagatctaagctgttaaaattacctccttcagccctatgttttaggcaagcaaaagtgctgttaatttaatattcattgtttatgattaatagaatattatctaacatttatgatatagcagttatatttgcataagctgttatatacagcatgctaaggtctcttgtattagcaatgtagacagtttctttatgtccttttcataatatgagcagtataattttattattttaaataactataagagtacatcatggtgactatggctcataacaatagattgtgtacttgaaaattgctaatagattttaagtcttctcacaagaaaaaaataaaataaaagtctatgatttatttgatacctagttcttggccaagaatctacctcccctcaataacaatactgttcctgtggaaaaataagatacctttaaagcaatcaattttatacatttatcaaaaatatttgaaaggaaaaatacttcaaaaggctcagaacaacaaacagaaaaacatctgccaagcactgcataatttaatacaacatgaatgcaagtgtaattaaagatattcaaaatttcttcaaaaaggttgttcatattattactttgacagcagatgattcctattcccatgctcacaccttcacttaagattagcacaaatttattttgtaaaatgcaatcaaatgctattatactcacgaaattgcctcttctctgttttctccccaagaaaagcagtgaccaaactgagaatcagcaaattcatgaagtccccctgcagcagcaacactgaaatatccccaaacattcttattgctgcggaaatttagctcctgaactgttcctgagctgggcttaaaaccctgttagagaataaagaatgagagaccatattatgtttcgaaggaagagaagatttatatattcattgtttaagttctctgttaatcacacacagaagcagagaagacacacaaaaatgataaaggccaagacccagtgccacagacccactgaagactctacagtgacttaagtgggattaagtaaccaatgaagcaacaaccatttacttatctgctctgagaaacctctatgtttcccactccagaggaagtcccaagatatttcagaagtatactttcagatactatcttaacattaaagttcattaaaaggaggtataaaccttttaagtgatgggttacctcatctggattttcactagtgatccgagcagcaataacatggccccttggacaaggaacgtgtgcagaatcttcaaaatcaatgggagaatcaccccagggagataccccatacatcatacggatatccttgattctatatagaggaatccccatggcaatctgaaaggtaataaaacacacatctttaatttttcagttacttcccttaaagtgtagaggctatcagataacctaaaatatttttatttttggagccactccctaaaacattctatttttataacctgtattctacaatcatcaactctaagttgcttgaaatacaatatatcactacagataagtagttagaatattctccacttctaaagaagtccccacattcctaatgcaacagacaccagttcccctgttgtcatttctccatcacgtaataagaatgaaaatatccaacagaggagtaaatgttaatagccatccaaaaacagacagctagaaagtcttaattgtgtcataattatctcttccatccctgcaaaccactggaggaagtaagtaaatctttagtctttaataggaacccagaaggtgttctcgatgtgggcaaatgttagataaaaataatatcaagccttatcattaactattactgctttccataatatttgtttcctgggctgagagaagacaataatattgacagcaagcactttacaaattataaaaatatatgtgtgctaccacactcttgtaaggaaaaacttcaaccactaatctctgatgcagaattatttcaataaagaacactagtaaaaaaacaaaaatgagtagggaataattataatacaaagttgtgaagtttactatagctaaataattgaataaagcatacattattaacatttatttctaaaacatgacacattatatcagatgtgtctggctagaaaaaataacattcctatgtctgtactacatcaggaaaaccaaaccacacatgcataacacatacagggtgaaagagaaatgaccattaggtgtgactcagataggaggtgcttttctcttatcacacactggttaaacccatttttcaggcctctctgacttttctaggctctgcaacccagatcagggagactcacctggagctgtgctgcagggagattgacatcagccaccatctctgtacaagggtgctctacctgcagccgaggattcaattccagaaagtagaagctgccatcctggctgtacaggtattccacagtcccagcactcacataacccaccattttggcaagtttcaccgcacactcaaagaagagagataagcaaacataagtatctcaccttatccaactgctagaccactacagcctctcactgactcaactgttcagtgtgtataagagccatcaaaagcttttagccacatgagagcacatttctgattattatacaatatccctggacaaggatgaaaaactcaatgaaaaatcgggagaaaagagcatttttcactttgcatcaaaagcaacctcaccccaccagacataaatgcatgcagacaaaaaaacatggggacagactcttgtccagtttccagtatttccaatatgctcctcttctttctagaaacatagctaactagttagagactagatttttttttttttttttgagacagagtctcactctgtctcctgggctggagtccagtggcacaatctcgtggctcactgcaaactctgcctcccgggttcaagtgattctcctgcctcagccccccaagtagctgagattacaggcatgcgccaccatgcctggctaatttttgtatttttggtagagatggggtttccccatgttggccagcctggtctcaaactcctgacctcaagtgatctactcgccttggcctaccaaagtgctgggattacaggcgtgagccaccatgcctggcctggttagtggctaagttttgacaaacaggacaccagcattggtaagtgatatgcataactcccaagtcatatatatatatatatatatatatatatatatatatttttttttttttggagatggagtctcgctttgtcacccacccaggatggagcacagtggcgcaatctcggctcactgtaacctccgcctctcggattcaagtgattctcctacctcagcctcctgagtagctgggatcacaggcacatgccaccatgtcaggctaatttttatatctttagtagagatgggttttcatcatgttggccaggctggtctcgaactcttgatctcaggtgatccgcccacctcagcctcctaaagtgctgggattataggcgtgagccacagcacccagccctaagtcatattttgaaaaggaaatgtctcattctctattcctggctttttccttcttattcattggaacatagtcatgatagtataagccaacttcaatcatgcaaatgagaacacactaagaacaccaagaaaagaaaggaaaagaaaagaaagaaaaagaaaagaaagaatgaacctgaatcccaagatggtctcgtggaataaaacacttccaccagccctgaaaagctcacctcagactaggatgggagagaaaaataaacttctatttttgggggggtccgctgtgttttttggacctttttgttatagcagtttaacctgtatcctaatcgatacaggaattattaagtgcaggtagaatgttgctgtttaaaaatattaaaatatgagatgctagcttagcaaaagggtagtgggtagcagagaaacagatactgcaggctggaaaggtgataatctccttgttgggataacacaacatttggtaaactgtttcctacaataacttgggatactgaccacacaccaactaaaccttaaaaaagatggtctgaaagggtcagagtgtcgaaaaagccaacttcttttgtatccccccaaacagaaaatgagattatcaccctgaagcaactcagtgtcaaagatcaaacgtgctgctttagtttcagctggccccaagatagccaatattaaatcaaggcaagagagataggctaagcacagaagccagtaaataatagaagaaaagtttctatatctagaagaaatctatgagtatgattaatccaacccaaagctgattgcaagcaaatagcccagaagcttagttaagtatttgaaggaattgtatttctaaacaaaccacaaacctggccttcaaaagcctgcgactgatgattgggatatttgtgccctcaatcctgcaccagcaggaagtgggttgtgaaagttctgccaaagaaggcatagtctccaaagcccaactcacagagaaaactgaatgaggaagaacttcccagaaaacaatgtcaggtgtcttgaaggacaatgaacaagggatttactcccttattgcacttctctggagtgtgcagtagcagaaccagggacagccaggtctaactgaggtagtattctattatatagcagggaatcattgcaattcctacctaaaaaggaggatttgataactgctatggaccaacgattgctatgtatttttcatttttccaaatgagagttatcctgttcctattccatcattgtatatgggtgtatggtgaaggcaggggatataatactgggtaaataacttgtattttgagtcactggcccatgaaaagccacaatacatatctaatggagaagaatatacatcatatagagatccggaatcacctccagtaataacccatccagttactagtaactggatggggcttcaggttgtcttccttggacaaaggctatgtgtgctctgaaagtaggaaaaaggataaagggataataggtagccagaggaacagactgaggcacagattatgaaatgccctccagtgacttttctctacttcatcattttaggaataaaatcgaaatttttgctgagcacatggtcacccagttagtgatcacaattcctaacatcctttgtgctaggtataattgtgtaactgaattttgtccagtggaatgtgagcagaagtgatgtatgtgacttcaagatcatgcttccatatgcttgccctccacatcccctgtctcttcctcccacaggccacaatgtgaacataatcttgtgtgagttagcttaatcatgaagatgacaatgtccaagagcaaagtttggcaaacttttttggtaaagagccagatagtaattattttcaattttgtgggccatatagcctctgtcacaactattcaattctaccattgtagtgataaagcagccataaataacacataaataaataagcatcattgtgttccaacaaaattttatttacaaaaacaggcaacaggtgagcaataaacctgtttctggtaacagctcatctctgaactatgatgaaagagaaatagaaacttacaccttgtttaagccaccgtattttgcttatttatttatttgttttgagatggggtcttgctctgtcacccaggttggagtgcagtagcatgatcaaggctcactgcagctttgacctcccagtgtcaagtgatcctcccacctcagcctcccaagcagctgagagtacagacgtgtgccatgacactcagctaatttttgtatttttagtagagatagggtttcaccatattgcccaggccggtctcgaattccagggctcaagtgatctgtccgccttagcctcccaaagtgctaggattacaggcaagagccaccatgcccggccaagccactgtattttgaaggcatctttattacagcagttcaagagtacatcctaatatatacacaacataggaaatagacctctaacacacatgaaatatattttgaagaatctattttgatgtagagactgggttaggactccagaaaagactatgttcaggcctctaaactatagttattccgaaggcatcgctcatgactttgagaaactactttctatacaaaaagatagaatgtgtgaactctgaagatatttagaggactttccaaaaacgataatagagttgattaaattcagctgaagacttgatgatactcaacccagcaaataaaactacctgattatgagcctcttaaaaaaatcaatcataagattaaaaattccaaaacatttctcttctttatccctgtatcctgaaatggtacgctgattttttttagaaagcgttaactacttttagaagcttgacatgttccttgacaattctcttagtgggagaacagtagaattttttttctctaagaaaaggatataattttattaattattcagaatcgttgcttaaaatgccattgttctcagattggtacatgaactgaatgaaaaatgttctatgtaagaaaacataaagtaagccttttaatatatgtacctgttccatgtgttcaaatactgctggagtagcaatagtagcaggtgcttcttcaataatcttctgatgcctgcgttgtacagagcaatcacgaccaaacaaagagatagcattgccatattggtccgctaagatctgcacctccagatgacgagattgtttggctagtctcatcacaaatatgggagatccaggaacttcagcttgaacctgtattagaaaagggggaaaaaaaaaaccaattcttaaattttaaactttttatctatcttgataagctactttgatttcaacaagcagatgtccagaagtgtcaggaaccatgttaatcagcagaaatacaaaactgaataaaatacagtccatgctgtcatctttaatatctttaagatgctgcattcttacataaccaatattaattgataaatatgaaaacatacgaacatctggtgcatcacaaaggtaaacaacaaaatatttgaaaacataggcacatacacaaatccaacaacagggcaaaatactgccatcctgtactctgtacaaccaaatgtacaacttgttccagacaagatactttcctggttcacattacatcatatatggtattgttgcagccaaaggactttcatctttagttttgaagaatattactgttggggacagaattctaaaatggtaactattttttttctcagcactttaaataatcccaatgattttcagctttcactgtttctactgagatgccaactgtcaatcttattgttactattttgaaagtaatctttattcctcagctggtttaagattttctctctttctgtcttttataggggggagggtggtagatttactctgataagcatagatgtggttctttgtatttgtcttgcttgaggctcatagtgctttttgaatctgtccttggtatcttttatctgttcaaagaaattcttagcttttctctcttcaaatatggcttctgcttcatcatttcttcaattattgtttctgctccattctctttctcttctcctctgagacttaaagtacatgatgttagaccatttcacataaccatatgtcttttatgctctgtatcttttttgctctgttttgccatgtagcaagtcatctcaaaactcagtggcttgcttagaacatcaaccttttatgatgttgttctcatctgggcagttcttcttctggtcttgcacttacatacatatcatcatctggtagcttgagtggggtagaatggtctcactcagatgtctggtgatttgtgctgactgctggctggtaggtctagggagcctcagctggaatcgttcatctccaatgcaggtggcttctcatcctgcagcaggctagactaggcttcttcagtgatgtgttccaagaggggaagaagctgtaaggcctcttgaggtctaggctttcgaatttatacatcactttggccacattctaatggtctaagcaagccacaaagccagctaagattcaaggggtagggaaaatagatgccacccctggaagggaggaacagcaaagtcacattgcaaagggtgtacatacaggaatgggaggagttattgtcgccatctcttgcaaacaacttactatgctctaccctatggccacaataattcacatacctcccacatgcaaaacagactcaccccctcccaagacccccaaagtctcatccaatcatggcattgggcttgacgtccattttctcatgagtcatgtccagaagaaaatgaggttccttgggtgcaactcctcaggtacagtttctcttgatccaaagacctgggaactaagaagacaagttatctggcccaacactcccaatatttatgatgatattgggaggggataactgcaaatgagactgctgttcaaagaggaggaaataggaggtacatagtagtcattggtccatagcaattctgaaatccagataggtacatgctgtcagattcccttactccagggtcaggaatgcttttcattttgttttgttttgttttgtttttcaggatctagtttggttccctgggagtaggtccttaatccatggcatcccctgctcctagctctgccctctgggctcctgactccactctctgagaaatccctctttttatttgaaatgacagctatttacagctgaatagctttctgtctgcttcctgctcattaaaaagtttaaggctcagaggtcacttttcattttgaactgtttctggccctttcagtcccttggtgcattcatcaacacaagtctcttgacaactttgtgggtttcctatgaatcatattggggttcaccgctcacccaaagagacacatccacaactcatgtctgcatagacctctctatactttgggcacgtcaggatgctgtgagacagtacccttaagatacttagggccaggcatggtggcttatgtctgtgatcccagcactttgggaggccaaggtgggaggatcatctgatgtcaggagttcgagaccagcctgagcaacatggtgaaacctcatctctagtcaaaacacaaaaactagccaggcattgtggtgggcacctgtaatcccaactactcgggaggctgagacaggagaatcacttgaacctgggaggtggaggttgcagtgagccgagatcgcgccactgcactccagcctgggcgacagagtgagactccctctcaagaaaacaaaaaaaaaaagatagttagaagcatgtttccagctgaaagcattaaaaaaaaaaaaaagatacttagaagcatctttctagctgaaagggtaatttattagctactaccttaaagatttctgaggccttaaagtcacaggcactcttgacttggtctttactctgaggcattttttactttgcaaatcttttgccagctggagagactcgggatgagaaacaattctattttcaacaagttctgggtcctttacatttctgtaaattctgcttgtaagcaaaacatcttctttagcttacctctcttttacagttttttagcataagcaactagaagcactccacagatactttaaacacttgtagagagctccttaaccagatccatgacttcattaaatatattatttgtcttccaagttacctcagataacatttttttgccaattgttccattattacagaacatggatcttttttccagactccagtaacaattactacactgcttttccagcctcccttaacaattcatcattcttccagtcttcattaacatcctcctcaccaatgttcagcctacacctatgagccagttttaaagtcaatgtcttacgttttacttttctgttatggcaacatcataccgttaggtatcaatttctgtgtcaattatccattgatacctaacaaactaccaaaatcttagtgacttggtatagcaaccattttattttatttgctcatgagtgtgtggatcagcattttgaactgggcacaactggcagttctgatcttgcctggagtaattcatgcagctatagtcatctggcagctcaactggggttagatggtcaaatatggtctcatttacatgtctcaaatgtggtgctgctgactgtcctagtaggactaggaggccttagctgggacaactcatctctgctcatgtgacctctccttctctagtaggctagaatgggctcttcacatggtagtctgagggcttgctccaagacagcaagagcaacaactacaaaaccattgcaaataatttctcacattgctctatgtttttcatccttttgtctttcttcatgcttcagtctgaatttccttctgatctactcaccagtcgttaattatttatctttttctagatttttttgttttgtcacccaggctggaatgcagtggcatgaccatagctcaaggcagcctcaaactcctgggctcaagggattctcccatctcagtctccagtgccagttactgattctcttcaactgcatctaatatgctataattttaaactcctatattgacttcttcttcttcttctttttttttttttttaagacaatgtcttgctctgtcacccagactggagtgcagtggcacaatctcagctcactgcagcctctgtctcctgggttcaagtgattctcccacctcagccacccaagtagctgggattacaggcatgtgccaccaggcccagctaatttttgtatttttagtagagatggggtttcatcatgttggccaggctggtcttgaacccctgatattgacttcttaattttagttattgcattttcagttctagaacttttgtttcttctttatgatttccagttctctaccaaaattctcaatcttgcctttactttccttgaatatattacgcagaattactttaaagtccttgtctgataatctcattatataaaccctctgtgggtctgtttctactgttttgttcttcttggttttcaatcatctaattttgtatgcctattttcaattgagtggttgataagctgtaagaaaaattaatagaaataattttaagttctggatgttatctttctctggaaaggatttacatttgcttcctgcaggtgtctagaagcactagcaatcctaaaacatcttgcttaaatcagaggttgaatgttttgaagccaagatttagtccctgtgagggctagtctatttccagttcaccctttctcccatgatgtagtcagtccttaaagatcctaacctaaaatgtgggaggttttccagggcacccctccccaggaagccctcttagtcttttaagactgttgaaaacttatcagcctttctactatcttgaactagaagatatatctaggggaaaagtagcctcatatgtcaggctcacatctctgggtttcctttttctcttgtatgttagccccataattcttcactgtcttgaatggtctctaatgccgtaaaatgtaatatatctatatctatatctatctatctatatatatatatatatatatatatctggttcagcttttctagtttgttcccaatgggaggattagtttattcagccaactagtattgaaacttaaggactttcacagaaaaccttcccttagtgttttaagacttttccactatttgattccataagtaatgagtagttttgaaatgtctgtaagagttaacattaattaacatgccttttttttctttttgcttctaagagcagtcttttttctctagactctctgagtcactgatctacctatgaaattagaattcaatgaaaaaaatgtaaaaaaaaaaaaaaaaaacccaaggtaatattcaatttctgacacttaaaataggataatgtagcaaaacaataccttatttattgatttatttattttacaattttttgtagagatagagtctcactttatcttccagactgatctcaaatttctggcttcaggcaatgctcccgctttagactcccaaagtgctaggattataggcataagccaccaatcctggccaagacaacacctttatcacttcctttatctagtacagatgctctttgacttacaataaggttatgtcccaataaacccaacataagttgaaaatgttctaagtcaaaattgcatttaatatacctaacctaatgaacaccatagattagtctagcctacctcaaatgtgcttaaaacacattagcctacagttgggcaaaatcttctaacacaaagcctatattataataaagtgttgactatctcatgtagtttactgaatgttgtactgaaagtgaaaaacaatagctgtatgggcactcaaagtaagatttatactgaatgcattatcacttgcacagtattgtaaagttgtttgtttgttgattgtaagttgaaattttaagttggggaccacctgtatatgaaatcatggaagacccagctcataagactttccttttaactcttaacagtgaagcaaggagtttgctgctaagtgttttaagggaaaaaaaaaaaaaaaaaaagcgaaataaaaggtagcatggcacactagtaaaagaagtgcaaagtagaagatgatgaggaaactatgaaaaagagggaagctaggagagtgaaaagagcagacttctgtcccaattttccattttttgacaaatcttttactatgtattggtaggaggaaaaaaagtgagttaaatatgtgagggtaactctgaggacagaacaaaaagagacccctgtctcccttttctctttctgtttaagattctaaaaagacatcacttctttggtcgtctccgcaaccaatgtatagtatggccacatcaacttggctgcaaagcagagggtaaggcaaagagagatcctacatcgagctttcctgagtcactctcagttcctatatactgtaggcctgccatagggttcctgtgccagggtgtggtggccatgcaacacgggctagggtatagagtgctgggacagcagggtagatgagacatatgatagaaactcagaggtctctaggcaatgtgaactaaagtgagaaaaagtcaatcagagagcctgggcctggccaagccaagagcaaccatatcagtatcataccaccatatcacatatgacctacaaagtcagcagaacaggggcacaaaaatacagaaaggtattgatttttctttgtcattatgaggtcctataagccatacgcaccatgtaggaaagagctatctgacaaactgagcacgtttatataagacagaataactctactgtttgaattacctaattaaataaaacttaaaattgagttggacatttcattaaccttttttctctgctaatatgcaggtagaaactagagagaaagacagttagctatagacaaaattaaaaattaaatattttctgggcatccaaattatagtatgagttaaatcatatatctctgatatacatgttagttcaaacaaacaaaaacagcttatactctacctgtctgaagagattagggaagtcatctgcattgttgacttttctaattcccttccctcctcctccctctgaggccttgatcattactggatatccaacttcctcagctgccttcaaaaagaaagaaaaaaaaaatagaagaaacagtgttattaccagggaaggagaaaactggcatttttctccctttaagaatgcagtcatttagtaattctaaatacaataaaatagaaagatcttcaagatacactatgaaaaaataaatagtagaacaatatttgtagtattaggttgaaccaaaagaaattgcctttttcatagatttaaaaaaatgactgaatataggcaatttcttatggttcaatctaaagtaatgtcacatgggtcaaaaacaaaattatatatgcattcatacacccacacatgtaagtgcaaagaagtgaagtccagagtacataccagcaatgatttagaaaagaatgggtccgggcacagtggctaacgcctgtaatcacagcactttgggaggccaaggcgggcggatcacctgaggtcgggagttcaagaccagcctgaccaacatggagaaaccccgtctctactaaaaatacaaaattagctgggtgtgatggcgcatgcctgtaatcccagctacttgggaggctgaggcaggagaatcgcttgaacctgggaggtggaggttgcagtgagccaagatcacgccattgcactccagcctgggcaacaagagcgaaactccatctcaaaaaaaacaaaaacaaaaaacaaagaaagatgcgtggatataaaactttcctttttcactgtatgtatttctgcattattggaatttcttgcttatagtatgcaggcatacatgtattacaattaaaaaaaaaaaagacataaggagttcacttaaaataagctgaagtggggttgggcgtagtggctcgtgcctgtaatcccaacactttgagaggctgaggcaggtggatcacctgaggtcaggagttcgagaccagcctggccaacatggtgaaacccctggccctattaaaaatacaaaaaattagctgggcgtggtactgcatgcctataatcccagctactcgggaggctgcggcacgagaattgcttgaacctgagaggcaaaggttgcaatgagccaagatcgtgccaatgcattccagcttgggcaacaaagtgagaccctgtttcaataaaataaccaagtcattcctttgtcaaaatattccagtcttttaaggttttgctacattataagaatatctttaaaatgtatcaccaggcctggcccagtgcttcacacctgtaatcccagcactttgggaggccaaagtgggtggatcacttgaggtcaggagttggagaccagccagcccaacttggtgaaaccctgtctgcactaaaaatacaaaaattagctgggcatggtggcggtaacctgtaatcacagccacttggaggctgaggcaggagaatcacttgaatctgggaagtggaggttgcggtgagccaagatggcatcactgtactccagcctgggcaacagagtgagactccaacccaaaaaaataaaataaaataagtatcacccagaaaaagaacatttcaatttttaatctatgtcaatcgattacttaatgaatgaaaatcttttatgcacagtctcaccttttctaatgtttctttattcttttctatgctcatataaacagaattagtatgatgaactcaattgctgagtgatagatgatcaaagagatagcttaaaaaaaagagaaagacttaaaaaaaaaagggggtatcccataggaggtcagtaagtaagaaggtaggccttttaaaaatatatgaaagctttagtcacaggtcacccattaaaaatattttggaagaattttaacactttaatataatgttaagtaaggagcggggaggtagaaggacaaaaaaatattaagtagaaaaaagtattatgattaccaacacaatacaaatagtaagacccaaaacttataattatcataattataagtataggaatctattaataaagatttgtatatgatataaatctatgagttgaaaagggataaaaaaatgaataggttaatgggcattatctttggatggtgtgtttgcatgtggctttatcatcatctttggcttttcaaattttctaccagaaaatgctgtttataattataaccagaaaaaataaaaaagaatgttagtcgataagcaaaatagctagaatagctagttccttacaaagagcttctactcttttgcaaattataacaaacaaaataaagcatttgaaattcaattagaaatattaattcttcttattaaggagattacaggatgtttaacttaaaatgcaaacaatacaacaaaattatttgaacattcagcatccctcttgaatttacatgacacaagtcaaactcaagcagtgtatttttctacaatagcctctttcattatctttcattatacctggaagcataaccaacactttaaactatttataaaagtgaaaggggaacaaattggagggaactgtaaggaaagaaaaggtaatgttggggaaaggatctccttttgcctaggttcacatttctacatggatagacaataattaagagtaacactttcagtctttcttggttcactcccttgctcctccccaagggaaaaataataaattatgtgattggtcaacttggaaggagggactgaatatgcatagctcagccttttcccctttgggatcagcccactgcacaggacatatgctctttgtcagctctcagccatacactaagctgaattaagctctctctctctgtcgagggaaatctgtggtcattcagcactgccagtaaccagtgggtgagtgagcctgcttaactctggtgtttagtttacaaatctgaatgttgctacacacttaagccattttcatcaacatctctgttcataataaagctgactgtttgatctctgcttcctggcttcttggttctgaattcaaccagtagaaaaagtatgttgtttgttgtccccgccctcacacactaacaggtggtagagagagagagaatcagcacctccttaaaactctgacttaatcacctaagaaatgttctgtccagatgagcagcctgcttcaaaatgaatttagattgtttacatttaaagtcacttcctcaatctgtactttttaaaggcaaaagacttatgcaatctaaagagaaaccagcgtattctatactttcaaactacacctcctggtcttacatccctaacaccaccttgggtatatatcacgagccaggctcccaatctccacatttgtgactataactggtcagctgaaaggtatcactccctggagttagtaacctacctgtagcccatcatccacatctttcacataacctttttcatatagctcctggggaacatttaagatacgttttgaaaaatcattttcctgccagtccacacgaagacctgcaacagacaatagcaacttagggcaattacaagatcttctgctcttgtcaattttctgctctgcattctttgaaatgctatcatatttacccaaaactgagagtggatgggagaaagaaggatgccataaaaccctgatcagtccttggggttaacaggatttagccacagcatgacccggcaacttgggttcttaacgctggcaaaagccagccgaactaacagggagcaacttataaaaatgcaaagacgtacaagatcaaaacaaacaaaaaaagaacatagcatacttctcacagcaactcagcaggcaaaataccttcaaactgtgtgttcaggcctgctccagggccaagaggtctgggaaataattcaatctttatgagcccttggaaatagaaatggcggttttattggcctcagcagagtcatgattccatgctctctgaacgtccctgtactcagccataaggggaacactatagcctctccattcaaacaagaacaaattcaaccttttattttaaactatttgacccagcagatctggagaggatattgcaatctccctggagagccagagtaacaagggttcaaatctgttcagcctcaagacagtggtcattcccatttaaaagaggttttagtgtatgtctgttcccagtgcttgagtacttaagaaaaaaaaaaaaaaggttcatattgttatcagctataataattcacatggaactgtttaagggatgtgttgagaataaatcactttttgaaaattcttgcccctctggcatgcctggaagaaaggttaattactgacctcattttctgcatcaagggcaactgaggttgaatggtttttaaacagtcaaatcaaatcatcaatagattgtgggttgatatcaagaaaacattggcgccaggcgcggtggctcatgcctgtaatcccagcactttgggaggccaaggcaggtagatcacaaggtcaggagttcaacaccagcctggccaagatggtgaaagcctgtctctacaaaaaaatacaaaaattagccgggtgtggtggcgggtgcctgtaatcccagctactcgggaggctgaggcagagaattgcttgaacccggaaggtggaggatgcagtaagccaagatcatgccactgcactccagcctgggcaacagagtgagactccaactcaaaaaaaaaaaaaaaaaaagaaaaaaaaagaaaaaaaacattggcaaggaaacatttgagtaagtgggttttaggtttttcctagtgatccaggctactcccaggcaggtctgaagacccaattccccctgggaagcccacctctgaggaagattctagcctacccagagtacatctaaacccacaaaaccatatatatgttttcccagagtttttctaagttaactcacaagatcactccagatcacaatttagcatctgtgtacctggaactaaatttatattactaaaagaatcacaggtgtattaattaagctaggagctacaaggtaccattaatcaaccagtattccatttcttgtcaagtataccaatactttttcaaaagaggtaagtcccaaatatcctactgagctattctgtacttcaagatacaaacaagaattcagttcttaccactgccgctccagggaagagttgggatacctgcagtttgagccactatggaagatgcaatcttatcccctaaagcccacatggcctggcttggaggacctaaaaacgaaacaggaaaagaatcctgactgtaaccccttggcctcatttctggcacatgtagttgccttgtattatagctatttatgtatttgtcttgtcctccccccacccctcacatatcaaggagatcataaattatggggactattatgctttgacttatctttgtaccatctgtaaaacctaatgtagtaagctttttgtgcagagtgagagctcaatatatataaatgtatgctgaattaaatttttgacaaatctagctataatgttatcattcttcatgatccaacttcaccagatcaataaagtcttcttttttaagtcaatatcctgaaataaggactttaaagttttaggattcaagtctgaaatagtatacgctctttggtcttaggggaacccaaaaaggagacatctttaaaaaggtttacaaaacataatcttcattgtttaaggtctctgagacagagagaaaaatactttgagctatataacctctgtttttctctctggtataatgacagcagaaaagtcagaagaagtatctctcacttgtaggagtatcacctatatgcttaaatgcacaggtgctgattcatatttaagggcacactgccaaggcatcctgagtattcaattatcttcactatctaaaaacaggtcattttcccacatgctttcttaaggttagctgcaaagttttaaaaggtcagagttttagaaaccaaagccttctccatatctccatatctgacccagggacagaaaacaaaatcaagatgaagtgagataagcaaaaaatgaaaaaaaagaaagaaatgaagagggttactctgagagttagtaatagattgagggaaaaaaaaagagagagagagcccagcacatgttaaacagaaaatcagactatagagtaaaatgtgggcaaaattgacagaaagaaacagaaagacggacaatatgtcagaacagcttacccatgaaggcaatgccatttttcaagagaagttccggtagtttgggattctcagaagcatgaccccagccagcccacactgcctgcaagggaatacaatataattcattcttaaaattcatacaaaacccccacaaactgcaagagtctctatccaggctggccctgtttcttgaggtacagtagttccacagcagcctaatgcttaattcagcttctatgcttgattgttggcaaactctttacagagtaacaataagtagtccattgtggcaagatttctgaaggggtcaaaaccaagttgaaattgatattaagatccagttatacttgttgctctttaggaaactcaattcatagcctaggctgtaaagggcgttttctagaaaaactggctatgtttcacatattcaattactatggccacgccattacatcattattgattacactgccatctaagtttagagttttttcctctttgggctttaaggtacctaccctaaacttactaacacaatgtgacagggaagaaacagcctacttctttaatataccaccatcctttaggctaatattccacaacaaacaggtaatttttactggctcaaaggtgagatacctagaataaataatctctgaaagatgcttccaaaccttctgtttgtattacgtttactttatttttagccattccattatttccatctttcttttccttatttggtttagttatcccatacacaggcatttaataattttcgaaaatgatgctttacaaaaatgttcttctctagatatccccttgtgcctaactataaaatggctgaatttggttttaaaggacacattggcatctcttacttgtactgggatccttttagcaatatcaagaattaattccacatttgcatagttgttgttgtttggtcctccaggcactggcacatagtgatctgccatcttaatgtattctgaaaatgcaagcgaattaatagagaacacatgatttttttttccagaaatataattgcacagcaaaactacgtaaaggtcagggactatcataagtaaccacaggacaaacagcattagtaggataatttccaggaccatttagttcgaggctcttagtttgttaagtcacaagcactaatacgagttaatcccatatttagaagctcttatagtaaaatagcaattctccaacatttcactatgtaatctttctgaggaatctttatgacttctatatcaaggctgatgtgtctgtcagttaggggcccaagtgcaattactctattccgagaaaaagttctagtcctgacatcctttgtctttaactggtactggacctagagaaagcccttttcctggtacagagcttgacagaatggagaaagataggagagcctgaatggcttgcaaactggctaaacaagaaaggttagttacaggagtgtctggaaagagtttatctggaatactgagggtaacaggtatttgtaagaaactttagaaagataaccactttctcatatatatttgttgtacagtattccctttcaaatttgtcacctaacatctctattttcctattctggcaatgacacctgtaacagaagagctaccacgtgtagggactgtaactagcactttgtatatatattatctcatttaattctctcatcaacccaatatgtgacagaaaatgatggcttggaggagttaagtaacttcctcaaagttcatttccaccatttataaatttattttagctttcaaatttcaactcaagcatccaccattatttactaataataaatttattttatcttgttcttttttaaaaatgtaagttccaggatacatgtgcaggacatccaggtttgttacataggtaaacgtgtgccatggtggtttgctgtacctatcaacccatcacctaggtattaagccccacatgcactggtaaaggacaggaacagacagacacttctcaaaagaagacatttatgcggccaacaaacatattttaaaaaaaacctcaacatcagtgatcattagagaaatgcaaatcaaaaccataatgagatatcatctcatgccagtcagaatggtgattatcttgttcttatttctaaaagattttaagtcccttctaaaaaaaattctactaaaaaaaattccgctagaatttcttcaaaattaaaataggcttattgttctctttgattataggaaggaaagcatgcaaattattaaacaatgttagataatacaacagaatataacaatactatattttaaaagtgaaaattggccaggcgcagtggctcacgcctgtaatcctagcattttgggaggctgaggtgggcggatcacgaggtcaggagatggagaccatcctggctaacatggtgaaaccccatctctactaaaaatacaaaaaattagccggggatggtggcacaagcctgtagtcccaccacagacagagtgaggctgagggaggctgaggcaggagaatcgcttgaacctgggaggcagaggttgcagtaagctgagatcacgccactgcaccaacctgggtgacagagcaagactccgtctaaaaaaaaaaaaaaaaaattagctgggcctggtggtgggcacctgtaatcccagccactcgggaggctgaggcatgagagtcgcttgaacccaggaggcagaggttgcagtgagccgagattgcgccactgcactccagcctgggggacagagtgagactctcacctattgtcccacctcaaagacaaccagtttatgctttactgtacataaatatatatatttttggtatatatatgtttaatattttttatggatacctaatatttcaatagcctatataattcatttgactactaacttatcaatggaagtacagattatgtataatttgaaaaataataaaataatgtgtgtctctgtacggctgtccaattatatccacagatatgttactagcaataaaactattgggtcaaaaggtattcacattttcagactctcactagcaacatgggtaccaaatactctcacctatgttaggtattatcaatgtcttcaattttgtgagttttgtaagttaaaaaaaaatctttagtattgttttggtttagatttcttttttgtttgtttgtttgtttttgagaccagatctcactctgacacccagactggaatgcagtggcatggtcatggctcactgcgacctcgacctcccgggctaaagtgattctcccacctcagcctccggagtagctgagactaccggcatgcgcctctatgcccagctaatttttgcattttttgtagagacaatttcaccacatggtccaggctgaccttgaactcctgggttcaagtgatccgcctgccttggcctcccaaagtgctgagattacaggcgtaaaccaccatgcctggccctccatgctttttatcaataaggtataatctcttaatcttaaggtagagtatcttcacagataacatgaagaataatatggtatcaaggatttgcatcaaaataattgtgcacggggttaagaatatagatgaaactagattcgccataagttgataattattgatattgcatgacaggtagatgggaagggattcattatactcttcaacttttacatagttaacacacacacacacacacacacacacacacacacacaccccaaaaaacacattcatttaaaatgcaaatccttagatgtccaacacacacacatactctccttaaaagacaaagtctgtgcttttgaggatggaaaacaaggtcccccttggcaaatactacatcacatcttgtagccatccgtaatttctagaaaaccacttgtgtcatacctttatgcatttgcaatgctgttctttctgtctggtacacctttctctccccccaattgcttcactaactcttactcattcttggttagacataatctctttcagaaagctgtctttctctctttttttttttttttttcattgagactgagtctcgctttgtggcccaggctggaatgcagtggcacgatctcagctcaccacaacctcctcctcctgggttcatgcgattctcctgcctcagcttccgagtagctggatttacgggcaccagcaccatgcccagctcatttttgtatttttagtagagatggggtttcatcatgttgaccaggctggtcccaaactcctgacctcaagtgatccacccgcttgagcatcccaaagtgctgggattacaggcatgagccaccacactcagcctaagaaagctttctcttaagcctgcccccaagaattagatgtctcatctctgtgttctcaccggaccctgtgcatgtttcttttatagcacttacctcattgtattgaaatcatttgtttcctagaacaagatcacatcttattcaactgtcagtctccatgttaagtgaatgaataaatgaattaattggagtaccaggtagaaatgaatgaggaaaaagaaaccggaccgggcgcagtggcttacacctgtaatcctagtactttgggaggccgaggcaggtggatcacaaggtcaagataccgagaccatcctggccaacatggtgaaaccctgtctgtactaaaaatacaaaaattagctgggcatggtggcacacacctgtagtcccagctacttgggaggctgagacagaagaattgcatgaacccaggaggcggaggttgcagtgagctgagtttgcaccactgcactgcagcctggtgacacagcaagactccctctcaaaagaaaaaagaaaaaaaccacgcaagttaatctgtatttattatagatgatctcatctttacaattatccagtgaattagacattaggatcttccttttataagtatgaaacttgtggctcagagatgtgaaagtgtgcatctaaatgatttcatataataacatgatatagtttgaatgtatgtccctcaccaaatatcatattgaattgtaatccccagtctcggaaatggggcctggtaggaggtgtttggatcatgagggcagctccctcatgaatggcttgggccatctccttgatgatacgtgagttctcactctaagttcacatgagatctggttgtttaaaagtgtgtggcaccctccccacaattctctgtgttgttcctgctctggctatgtgatgtgcctactcccccttcatcttcccccagtaagtgtcctgaggcctccccagaagcagagcagatgccagcaccatgcttcctgtaaagcctgtagaattgtgagccaattaaacctcttttctttacaaattacgcagcctcaggtatttctttatagcaatgcaagaatgatctaatatataacatttgctttctaataaattggtgtcttctcaatttctaaataagatgatataataacctttctttcttaggaataatcataataccattgtctcaacaaagaaaaaacatatgcagactaaaataagtataaaaggatagctctttttcgcagcttcctaggagtaaaagataaaaaaaagtaaaaaaacatagctcttcacattatctgtgggtactctaccttaagagattataccttagtgatagaaggtatggagaagaaagactagtcatatctttcagctataccaacagtctttatctacaactatcagacagagaaccatctgagtaaaaagaatatgtagccgaatttacagagtgaaacacacttcggtcccaaaaggtctctccctcaggaagagaaaaaaaaaatcttaacccaaagtttttctataattcaatataacgcataaggaaaaaacagcatttccttctaaatctttccacttacgcattccaaagaatgtggcatagcaaatatttaacactgaaaaaggcatacacttgaaagcccaaatcaacacttttgttaaatttcttcctacttatccctaggacacaggaatctgtatcgaggttgactatagtgcaatcatttttatatgtctattactgacacattttaaacagaaattattttaaaaggattttacttggaagtcctatgtttgggaatccccctaagttaacattctcctacttaaaggctgtgctgttccatgttttagttttgagagtgatgctttcataatgctaataactcacctgcattggctttaaggtcttcaggtgtgaccatgacaacgaatctaattgcacgttcatttcgaaacatttcataagaccacctacggatagaccgcatgcatttcactgctgcaatgccattgttagcaataagaacctgggagggggaaggagatgggaatgggaagaaaaggcagaaaaaagcaacaatggaggaaaagagatgagagaatttttacatatctatctttctgtgtaaaagtcatactttcaaccaagaattcttgttactggtccagactgttagaaactggcttccccaaggccaagcagtatctttaaatgttaactaagcaaatacttgagtatgtgccagctaaaacatactcctttctaacttcatttatttgaagggaaaagtcacaattacttaaatctgtgactttgtgaattattctaccatactaccatattgtgggtatggtatattatgaaatcaggaatgggggaaggccaaccagtgcagtgccatgcactcttctctgttgcaataaaatgaggtacagagcactgaacatgtttaaaaaccctggtattagttacttttctccaaaatactgaactccaataccttagaattgtagagaatgcctcagaaagaatggtcactgttgtagaaaaatagaataatcctgagactttctgtaaacaaacctttcgtctccttacctatcttgcagtcatgcctctaaggataacacagactaatagacacataatctgtctttattggaagactaataaaaggatgctgatgaagtaatacttttaggagtggaaatacaggtccccatcctttaatcttttaatcactggaagctatttcagccaagtcatcctctcagctctgacatggtttagacaaaagtgacacggaattacatttcaaaatacctggaatctctaagtatatcatgtggtatattcccttgaaacatctcaaatacttggtggaagccagtaagtcacagtgtatcaaactctttaagccttctcttctgaaactctctctactcccttagctttcaaaccagtgctgtggcatattatctccccaccagcacccacaagctaatcaattcttcataccctgtcagatcagtgcagccccaccctgtaaaaccacaagatctttcaaaaacatgttttgtttgagacagggtccctctgtcgcccacgttggagtgcagtggcacaatccatagctcactgcaaccttgaactcctgggctcaagtgatccttccattttagccccccaagttgctgggactcaaaaataactttatgagcactattttaactccttaattagctatgattaaattatctgtggtaaatacatattataggaaaacagtgaaattatattaataggatgctagggaggcagaaaggctaaaattcacataaagaggcaaagcctctgagaaactaaatatcaattgggagcaaatctagacaacaaatctaggcaagcattaaatcctaagtgcttttgacaaaataattcagcaagttacaacttaccttctcaatcactttatttcccccaaagcgagtaacaaattctgctggagaagccacagtgaaatctcgttgagaatctattttctttctgtctcggccctgctttactaggtgcaagccagacatgctggacctataaaaatacagaagccataaaaacaccacctatattttctggagacctgcttttcactaccatacccataacagtactttcacaactgcatcctgtgaagactgcatgctggcaggtcacgtacttttcaaataaaagagagaaaagaaaatgatcttgcttgtggaaatttaaggaaaaaaaagcgtttctgaataataaaagataatatcaaggtttaccagcagatgccatcacaaagagataggcaaaggataaatggtagaaataatagactcagagaccgttaaagccaaaaaacaagttaccagggttgtttctggatcacgactctggtgtgcagatgaccttcacctctgtatctctgacttctatctttcttctgagctataactccacattttaaaactgcctactaaatgttttacctgggtatctcctaggtatttcaaaatcaacaactccaaaacaaaattctttacaaggcagcataatatgccatatttaatcagttttaaggttctacttcttttctttttactttaaaaaaatctcctaggccgggtgcagtggctcatgcctgtaatcccagcactttgggaggctgagatgagaggatggcttgagaccaggaattcgagaccagcctaggcaacatggcaaaaccctgtctataaaaaaaatacaaaaattagctggcacagtcgtgtgttcctgtagccccagttacttggggtggggggtggggggcgcagctgaggcagataaattgcttgggcacgtgtggttgaggctgcagtaagtcatagtcatgctactgcactctagcctgggtaacagaatgagatgggtgtctcaaaaaaaaaatctgaaattggtatgtattttacaattgatgccttattaaattggcagtactgtttttgttgttgttttgagccagagtctcactctgtcgcccaggttggaatgcactggccagatctcaactcactacaaccttcgactcccaggttcaagcgatgctcctgcctcagcctgcagagtagctgagactgtaggcgcgccaccacacctggctaatttttgtatttttagtagagacaaggtttcgccatgttgaccaggctggtctcgaactcctgacctcaggtgatccgcccacctcggccttccaaagtgttgtgattacaggcatgagccaccgcgcctggctggcagtactgtattttttcttagtggtacataaaataacagtgtttctaacaatcaatggcaccttggattagacaaaatatgatagtggaaacagcacaggcctgggtttacattccagatctgtccacttaaatgatcttttgcaaataatttaaccttttcagcttcagtgttctctttgtaaaatatgcatgatatttactgtcctggttatttacctattgtctctcagctccaaacctacccttttatgctgtgctctgtgacaatggggccaagattctgcaaacttcatttccaagactcctttgctagctccttcctgttctgttcaccaaaccggaaggcagaaaggtaagaaaagggccttccttcctatttcccagctgttatcagtattgctccagctgtaacagaaacttaattccagtctctagcttctttcaacagtctggtgaaaagccatagaggtaccagcagcagtgggttgtggctctttggcagtcagaatatcaaccttgccatgctcactcatcctctggacctcactgcctgggcctatcaatcacctgtcaggccaaggatctgagtaccagctacccaaagcttatgcccagaggtccaggcaccagccctccaggagatctccaccaagctcctagttctggtaacactacctccccttttgttctcccagacttagaggtgatagctacttcctctagttattaactctggggtacctcagcatgccttttttgttgttgttcttttattcttctaacacccaattatgcaattctcgctattgaatgttctctgtttataacacctactacaatttattttccttgtgactgcaccttgactgatagaccctccaaaagagtgttcagaggattaaataagatagtggacataagctcctttgtacaccgtttgatagacagctgttttcttttcctattcccaccttttcttcccttcccctacaatttaaacttgatggggcagtaaggtgtcttttcaaaataagaaggtatgattaaaatcttcccacatgcagcacaatatctagctttctgtgcacatatagttttacatatacatacataaataagaccagtctttctttcttctctgagtgtctctatgcataaaactcaatgagtgggcattttccctatacttcacatgacttagtgtggctcttaacttgcaaaaccaccacctacgggagtataacaagaagggacaaggccaggcatggtggctcacacctgtaatcccagcactttgggaggccaaggcaggcggatcacttgaggccaggagttctagaccagcttggccaacatggcgaaaccacgtctctactaaaaaaaaaaaaaaaaaaaaaccaaatatccaggcatggtggtgcacgtctgtaatcccagctactcaggaggctgaggtgggagaatcacttgaacccagggggcggaggttgcagtgagcagagatcaagccactgccctccagcctgggcgacagagcgagactctgtctcaaaaacaaaaagacaaaaaaaaaaaaacaagaagggacagttcagagtctagcagctactttgcctactagacttaaggacagacataacaaaggctatgcactctgctgttggcactcaatataaaatgctctgtacccttcttagagactgacatttcaagctggtcaatctattaaaattttcttcatccttttctatccaggtatttagttatactgcatctggactggaactttaaagttaagaggcaccttatagaaaaagaggcccacaaggagaatgatttgtctaaggtcacaaaggaagtctgtagcatatatagaccagaaaaccaggtttcatggtcatttcaatgttcttccaattacactatgcaacatatctaatgataataaacaccagaggtctaaaaacagtgccagtgtacatgttttgtttcatttttttaatcacttcatttttctttcatacattctttttaatttttttattattgcatgtatttttaaataaataaaaattaccttcctgtccttaactttgtcatgaacctatttcttttgggccccaagtccatggatcattatcagtgtatcagactgagcaataacatgaatgaatctcaaaaacctcatgttcagagaaggaaaccagacacaaaaaagtatataccatatgactccatttatatgacaaggataactaatctacagtgcagaacacgaatcagtgggctggggctgtgggaaccgactgcaagggagtatgggaatgatggaaacgttctatatcttgatctcatagtaatggttacatgggtagatatatgtgttaaaaccatcaaactacataattttaaaaggtgaacttggcctggtacattggttcacacgtgtaaacccagcactctgggagggcaaggcagaaggattgcttgagcccaggagttcaagaccagcctgggcaacatagaaagagctcatctatacaaaaaaatcaaaaaattagccggccttggtggcacacgcctatagtcccagctacttaggaggctgaggtgggagaatcacttgagccaggaagactaggctgcagtaagctatgatcacaccactgcactccagcctaggtgacagagtgagatcctgcccccgctccaccaaaaaaaaagggtaaactttactgtacttaaattatacctcaacaaacctgacttttgaaaatactcatttacctgccaggcatggtggctcccgcctgtaatcccagcactttgggaggctgaggcggatggatcacttgaggtcaggagttcgagaccagcctaaccaatatggtgaaaccccgtctctactaaaattacaaaaattagccagacgtggtggcaggcgcctgtagtcccagctacttgggaggctgagcaggagaatcgcttgaacccaggagacagaggttgcagtgagccaagatcacgccactgcactctagcctgggtgacagagttagactccatctcaaaaaaaaaacaaaaaacaaaaaaatcatttaactgtccacataaaacaggtatatctggctgtaaattattcctcagtaaagttggcttttaaagaactgttactaatggtattgaaaggtaacacagagaataaggctaaggaagtacccacaccttgaaaatcagcaactgtaagtatggcacaatcaaacatttcttcatctgtcctcattatcttcaaccctctaggcacctccacttcatatcccacgagtatttcaaagtctgaggatacaaaaatgtcaatcaaaatgcaaactaggactgatcttcttaggaacttccatttttccattaccccatatacatttagatacctaaccaataccatgtgctctccggcagtaatataatctactctattacagcttggctttctcaacaacaggaatccaccactgcattatagtatttttgtcagtactactccaattcattcttcaaaatgcaactaaactgtcagtgctcccagtgagcctttgctgatggggatccttccaacttcaccccttaaggaggtaggtaactgagcttcctctgtgccacaccagaacatgcacttacatctttcctcccaatcacactggactgttacatgagcttaacacatctgttttccctgataaatagtgtgtgttccttgaggtcagatactcttattcatcccttgaggtcagagattcttatttattgctgtatctccagcaccaaagggtacctggcacagatagaagctgttcaaacatctttgggttttttttttagacagagtctcactctgtcacccaggctggagtgcagtggtccaatctcggcttattgcaacctccgcctcccaggttcaagcgattcttgtgcctcagcctcccaagtagctggaattacaggcatgtgccaccacgctcgactaattttttctatttttagcacagacggggtttcaccatgttggccaggctggtctcaacttcctggtctcaagtgatctgcctgcctcagccttccaaaatgctgggattacaagtgtgagccaccatacctagcctgctcaaacatttttgaatggtgattattatttattaattattgacaactacacaaaataacactatttctgagtactcgctatgggacagacactatgctaagctcttcacatgcactggcatattaatcctcgcaataatgctatgatgtttgagcaccattttacaagtgaggctcagagggattaggtaacttgcccatgatcattcacacagccagaagtaacaaaacagatctgaattcaacctttctgactctaagtccttgaacttgataccctacaatactgcctcaagttaacctgcactgaatatagtcacagttaattattcactgtatatccatgtaaataattatgtttttagagcaggggtatccaatctttttgcttccctgggccacactggaagaagaattgtcttgggccacgtataaaatacgctaacactggcgggcacagtggctcttgcctgaattccagcactttgggaggctgaggtaggtggaccacgaggtcaagatatcaaggccatcctggccaacaaggtgaaaccccatctctaataaaaatacaaaaaattagtcgggcgtggtggcgtgtgcctgtagtcccagctacttgggaagctgaggcaggagaatcacttgaacctgggaggtagaggttgcagtgagccgagatcacgccactacactccagcctggcaacagagcaagactctgtctcaaaaaaaaaaaaaaaaaagaaaaagaaacacactaacactaatgatagctgatgaaaaacacatacacacacacacacacacacacacacacacacacacacacatctcataatatttgtttttgtttttgttttgagatggagtttcgctcttgttgcccaggctggagtacaatggtgcaatctcagctcaccgcaacctccacctcctgggttcaagcgattctcctgcctcagccttcccgagtagctgggattacaggcatgcgccaccatgcccggctaattttgtgtttttagtagagatggggtttctctatgttggtcaggctggtctcgagctcccaacctcaggtgatccacccgcctcagcctcccaaagtgctggaattacaggtgtgagccaccgcacctggtcaaaaatctcataatattttaagcaagtttatgaatttgtgttgggcctcatccaaagctgtgttgggcctcatccaaagctgtcctgggctacatgcagtccatgggcagtgatttggacgagcttactttagagcaaataccaggtgatgtttctttaaaacagtttttggagaacaaatttcttagatctttgctgcccatgtcttccaatgtttacatataagccccaaatacatgccagtcatactaaccattacaaatctcaattctctcaagaactgaaagaacacctgatgatgttattaaataaatgactgatacgattatactaatctgagatgacatatactaaataaatgtagtcttatagttatcaaaaaattaagataaaattaaacatgaaggaaagggcaagagtaaaaggcagtgccttttaggagaattttttttttcattgaaactgtaaaaatgtgaagatactagaatgttaatttgactgctctaagaagtaattttttaactttgcacaaaacatagtatgaatgtcatatattcaattaaaaatgtgcttatgcatctagtaagcaaagctgaactacccttgcggaaatgtgttacctgttcaatggcctaagggataataggtaattttaaagagggtgatacgagcatttgtagagctctatataactgtataacatcatgtaaatttgtatgattttgttttgtgaatatagtttcaacttgctaagtaaagcagtaaggggcaaacactaaacttaccagttaaaaagcattaaacagttagactttgtaatgatagtctttcaaggtttacccttgctgccattatgctgctatgaaattctcaaagcatcttgagaaaaacaagctttgattccccttggaactttctaaacagggcaaagtatataaagtcctctcaagggaaagccagaagttaacaaaaaaaaggcattctataagcaagttaaaagaaagatcagactttaaacataagcatttttctgtgcatcatcctgaaagatttcaaaatgaaaagaagagaataaaaaaggataaagagtttaagaaaggccaggtgcggtggctcacatctgtaatcccagcacttcgggaggccaaggtgagaggatggcttgaggccaggaattcaaggccagccttgccaacatggcaaaaccacatctctacttaaaaaaaacaaaaacaaaaattagctgggcgtggtggtgtgtgcctgtagtcccagctacctgggaagctgagacaggagaatcgcttgaatctgggaggcagaggttgcagtgagctgagagcgcaccactgcactccagcctaggcaacagagcaagacttagtctcaaaaaaaaagaaattgactctaggcaaatgaccaataagtacttcagtgccggcactacccgtgcaaaacaggaaacaaagtgtgaagcaatgcaagcacatatgtgaaatttggctccacactaaatccggcttcatgcttaactatatattaaaaaaactggcaaactgccgacacatttttttttacaatacttatttttactttaatcaagactaagaactttaactatgaaaatgttaattagccaaatttctccagttctctatcaggttttaagcaatattttattatctaaacttttccacgtctttctcccctccttaccggttccttactacattgtttcataaataaccttttcaaatctgtaatttgaactaacttttagaaaacttccgaattagacaaaattattattttttctcactaatcacacaacactttctggcacattttgtatatagaattatgtgttaactagaattcttatccttagtaacctaaaacttcaatgaaacccgaaaaagcaagaaatcctgaaccatcagagataaaagcattatagataagaacaattccacaatttgtagaaacatatttccccatgtcacaaccttttcttaattggaactgacccagatattcaatgagcatcaaaaataattttaggacttttttttttttttttttttttgtgacagagtcttgctctgtcccccaggctggagtgtagtggtgtaatctcaactcactgtaacctcctcttcccaggttcaagcaattctccagcctcagccccccagtagctgggattacaggcacacaccaccatgcccagctagtttttatattttcagtagagatggggtttcgccactggccaggctggtctcgaactcctgacctcgggtgatccaccctccttggccttccaaagtgctgggattataggcatgagccaccacgcctggccaagattttaatttacacaaaaagattacctaaaacatttatcccattcactgtactcaattctttcatgtttaacggtttatttagataacttctataaacagagatatcagacactatcatttaaagttagttatttccttgctaaccatgtttttaatagccagcgaacataaggtgctcacctaaacctaagtaacagccttaaaggtaaatacactggtatttttttttgccaataactcagaagacttagttaacaacattaagttactctcattcgttgaaaaaaaaaagggcacacaaaccaagatcattttgtatgggctaagttagtagttttataaccttctatgccaaacattgacatctcaaaatatttagcagagacaaatataaaatccagacaaagaatgtattctgacaattctgaaggcatttctagttttattttactaataattttaaagccagcttgtttagtaaagttatacttaagtcacgtgaacttgaaaattgcttagacttatttacttaatttttaagtgctcttttatttataagccaatttggtagacacaacatgtaacaataagtgtgcatacaaataaacacatctagacatgtatagacgcacacaaacgaagattcaatcgcttttaactgggaatcttaaggcatgagatagcaatacaagcttggggggttttcctttgtttgccccaacagataatccaatgaaggctgtgaaccaaaatttcagatatagcagtttccacagcagtttgacacatgcaactccatcccactttcccattcaacagcaagctccagattccaaacaatattgggccaaacagtattgcaactgcgagagaaaattctaaggagggcttaatactagacctcagaactctgcctagggtgtcccctttggagaagttgaggtctggaggatccctgggccgtccccctttggggtccagtctcagagtgtcagacgtctctgaccttaggtgggcactggtgctgcttagcatgttttcccttcagaggcaatggcctactatgaggtttccttttgtccctggatgaaggcctggacttctggcatccttataatttgataaggccacactttcccatgcttcctgttccactagagtgatagccatgaactgtaatgataggaactggaggctgggtgggtttcttttgtccttagccagtagagtaggggaagggaagaatttagcatgagaaaacaaggtttaagtcactgaaacaaatgccagctcgccccaagctgtgccacacgtagggatcagggaccacaactggaaaagatagaaaggagtccttcagagtggccccggccagaaacctgcagttgcctctgtgtttaggtgctgcccaccaaccgtcccaagttggaaaggaaaagagagagagagactgagattcccctgtatggagcaggaaaaacaaacaagaaaaataaaccccaaactttgggattacctcctggctggcttgccaaaatatgttaccagtggaggctgtacaagttcttggtgttttgaacaaagaattgaacaaaacacacaaacaaagcagggaaagaataaagcaacaaaagcagagacttaactgaaaatgaaagcacacggccaggcacagtggctcatgtctgtaattccagcactttgggaggtaaatgtggggggataacatgaggtcaggagttcgagaccagcctagccaacatgttgaaacgttgtctctactaaaaatacaaaaattaggccaggcacggtggctcacacctgtaatcccaacacattgggaggctgaggcgggtggatcacgaggtcaggagatcaagaccatcctggctaacacagtgaaaccccatctctactaaaaaatacaaaaaattagctgggcgtggtggtgggcacctatagtcccagctactcgggaggctgaggcatgagaattgcttgaacccgggaggcaaaggtttcaatgagccaagatcgcaccactgcactccagcctgggctaaagggcgagactccatttcaaaaaatcaaaaaattaaaataaaaaataaaaaaaagaaaatgaaagcacactctacaggttgggagctggcccaagcaagccagccactcaagggtctggttacagaattttctggggtttaaataccctctagagatttccattgttacttggtatacaccctgtgtaaataaagatgatgaagttacaaagtcatttattcagtgtatatcctatgtaaaggaagaggatgcttcctgtcataactgaagtgcttgtttccatttgatttagttctagaaagttcttgggttccctgcctccaggtcctactcgcttgcatgattctcattgtgtcctcacagagtggaaggggaaaggcagatctttggagcctttttttttttttttttttttgagacagagtctcgctctctctcccagtctggagtgcagtggtgagatctcggctcactgcaagctctgcctcctgggttcacaccattctcctccctcagcctccagagtagctgggactagaggcgcccgccaccacgcccggctaattttttgtatttttagtagagatggggtttcaccatgttagccaggatggtctcgatctcctgacctcatgatccgcctgcctcggcctcccaaagtgctgggattacaggcatgagccaccatgcctcgcctggagcctattttataagggcactaatcccattcatgagggctctgccccatgatctactcaactcccaaaggccccacttcttgacatagtggtaattagatttcaacatatacattttgtgtgtgtgtgaggcagagtctcgctctgtagcccaggctggagtacagtagcacaatgtcaggtcactgcaacctccatctcccaggttcaagcaattctcgtgcctcaaccacctgagtagctgggattacaggatcctaccaccacacccggctaatttttgtatttttagtagagatggagtttcgccatgttgcccaggctggtctcgaactcctggcctcaggtgatctgcccgcctcggcctcccaaagtgctgaggttacagacatgagccaccgtgcccagcctcaacatataaattttggcaaagacacattcagacactatatatcaatatatacttatagagatatatatgcacgttttatttctatatgtatagccatgaggtttttatataaaaactatgttatatataaaacacatttaaggccgggcgcggtggctcacgcctgtaatcccagcactttgagaggccaaggcgggcatatcacctgaggtcgagagttcgagaccagtctgaccaacatggagaaaccccatctctactaaaaaaacaaaattagcggggcatagtggtgcatgcctgtaatcccagctactcgggaggctgaggcaggggaatcgcttgaacccgggaggcagaggttgtggtgagccaagatcgcgccatcacactctagcatgggcgacaaaagtgaaactctgtctcgaaagaaaaaaaaaaaaaaaccacacacacatgcgtgtgtgtacatatatatgtatatatgtgcgtgtgtttgtgtatgtatatgtgtgtgtatatatatatatatacacactttttttttgagatggagtttcgctcttgtcacccagactggagtgtgatggcgtgatctctgctcactgcaaattctgcctcctgggtttgctcgatcaagcaattctcctgccttggcctcccaagtagatgagactacaggtgcctgccaccacgcccagctaatttttgtatttttagtagagacggggtttcaccatgttggccaggctggtctcgtactcgtgacctcaggtgatccacccgccttggcctcgcaaagtactgggattacaggcataagccaccaccgtgcccagcctatatatacatttttgaaatatatatttatacatgtatatacataaaaaattttgatactatattatatatatacacaaacatagattatatatatctcagttactttggaaaaaaaatttttagagatgggttctcactgttgaccaggctgcagtgcagtggcaggaatatatctccctgcaacctcaaactgctgggctcaagcaatcctctggcctcagcctacagagtagctggtactacaggctcatgccactgcactcagctatattgtagttacttttatacctctttgcctctcagtggaagttttgcttggttatcccctcaaagggtggaagaagtggtaaaaaagaaaaaggggcaattacagaggcagttgggggaaaaaaaggaatggaaaaggatgatctaaagacagattttgccaactcagtgttttttgtttattttctgtctttgcctaagtttagtttaactttcagtaattttcttcaaaataaaaactctacattataaaaacaagcaaacaaaaaagataatggagggatgccaggcacagtggcctgtaataccaacacttctggaggccaaagtggcagaattgcttgagtataggagtttgagactagcctgggcaacacagtgagaccccatctctacaaaaaacttgaaaaaaaaattagccaggcatgatggtgcatgcctgtagtcccagctacccaggaggctgaggtgggaggatcacttgagcccaagagttcaaggctactgtgagctatgaccgcgccactgcacaagcaaatcattcaagtcttttatgtcaattctctgcagggaggtgcagacctgcaagaggcctgaagaaggcccaagaaggcctgactcatttcctcctcagcctgagttctaatggcaataagaaaggtcccaaagtgaaggagttcggcatcctgaacaactctgtctgactacataccacaattacagcaggcacctttcctagccccagacacacattctaaaaaagttttctgcaaaactatacaatatctttcctttacagcagttgaagagacttcactggaaatactagccaaatccagggagtaaatctgatacatctgaggttcccttcaggaaataatagcacagcagggtctgcatggggtgcttgttttcaacgtagctaaaatatcacacatgggctcagggatcttttattcaaattcccaatataaaataaaggtttagacattcaggagccaatatgcccatttttattcattttcttaaaaaaaatagccttcattttttaaagatagaaaaaaaatgatcaaataaatctcagggcttagctgtcagtaccttactgtttttttaaagatatatatattacccaaatgtggtagcctaacacttacctttgaagcatgtaatatctcatttccttattttcctctggagaaccctccatatcaagatgggaaaagaatggaagctttttcttcagatttcggccttgtaaacacaagccgcagttcctcctcctgttgcagctgcttaaaacccaggaggacaagagatactgtgccttctgcctggcttcagtcagactagaatactcctgatggcctcaaactatagtctttttgtctaattgttcccaatttccttctttccccacctttctcttcctttttgcatcttctctcctccacacacttagcttacacacacaattagttgatttcccaagggaactgagaggagccggggagaaatataaaagcttgtttaactagaaagtagatcttagcagctctcctttagttgcagcaaacattttcaacaacagtcactttcttctgacagtcaacggagaaaagctccactgcctctcctggctgcc

SEQ ID NO: 1161 - DNA, 214766 bp, Homo sapiens; identical to SEQ ID NO: 1160

SEQ ID NO: 1162 - DNA, 324976 bp, Homo sapiens; identical to SEQ ID NO: 1158

SEQ ID NO: 1163 - DNA, 295071 bp, Homo sapiens
cgtctcgcgtctgggaacggccgggcccccagcgggctgtggtcgcggggtgggggccggagcggcgaggccccccttaccgggctgcgcgggccgcccagggcccccgggctgagacggggccggagcggcgccccggccgcccgcgcggggtctcccccatggtgcagcggggttcgggatgtcgaagacgctgaagaagaagaagcactggctcagcaaggtgcaggagtgcgccgtgtcctgggccgggcccccgggcgacttcggcgcggagatccgcggtggcgcggagcgtggcgagttcccctacctggggcggctccgcgaggagcccggcgggggcacctgctgcgtcgtctcgggcaaggcgcccagcccaggcgatgtgctgctggaggtaaacgggacgcctgtcagcgggctcaccaaccgggacaccctggctgtcatccgccacttccgcgagcccatccgtctcaagactgtgaaaccaggtacgccggccctgcgtatctgtctcggggtgttggggagaggggcttcagggtgggcgtcctgggagcggcggcacctccccaccgcgtattgtcccgggtaatcttagacctctagggtgtgccagactccttgacgagggggaggggtggcgttggtgagtcccattttgccgaagggaaaactgagctctggcttggcgcggttgctctgctagctgtgctagctgtcacagaattgcgactagaagctgggtttcctacatttgtagctccatctccccccgcagacaagagtttttgactagagaaggccagccttttcctgtgttgtgcaaaaaggcccttaggattgtaacattttctttggaacgatcttacgcatcttctaacagggaaaaagggactttactatagaggcacttggtgccaaggttaccacctggtgtacctggaagggcttagctgcttcagtgtttcttgcactctagcagacatctcagagctgacagcctaactctgtcagtccaggtggttcaggtgtctgagtaccgatgacggtacaatatgtgatatgtggcagactggtgtgttcttgcagggagctgttgaatagagtctgggttttgcaggaagacctaggtgcctagcggagtgaaagcttctgtaacgcttttgattttacagaattttgttgaagtggtaggttaaaggagcctctgttgccctggtatcttttatgctagtaaaaattgctgcaaagcacgttatgtttatggcatactcgtcagtttcaaagcattgatcagagacagcatacagtgagatctgatagtatgtagtagttcttatgaatttgttatagacagcattgttggttttgtttcagcatagatagaatgtggttctgtcgtcttagatgtttgtgggagagagaattgtgattgtaacattattagaaaccaaactgtttttccttaatgtgctctgctgagtatacggtgcatcaaaatataatgggctggttaattgttacctgggctaggtagcagtccatcccttgatggcaaaatgctagaaaattctggataaaaatttaatatgttatctccttctcatttctttctcagcagctcgctttggaaatattaatatatctttaatagtccttgagcttaatggggcttgatggtttgtggtgcagtttacatatgtctgtgtattgtggatatgtatacacacagactcacatgctcctaaggtcataattaagattttctttctatagcgtattccatcgtattcattttaagtgtatgggtttatgtggtgaggttttctttttattgttgttaattttttaaaactttggcagactttaaacagctttttctgtatagttttgagaatttgtaaatttttttcttaactctaacttttacagccatgtgtgaaaggcagaggaaagacttttggggctgtaattcagctagtcaggcactgtctgtaatatgcaaaaggctatatagacagcatttactagtctagctgccaaatcttagttcaaatcccatgagttagtgaatagtgagaacatctgcatcatttctttgtgttttgttttgattcgttagggcatagatgagaatataacttatttttagaaattttaaagttgatatattgacatggaagctggtgtattctaaattattgtgatcttttttagaagactgaagagatggctatttcataacattagtctaatctacctgttatacatttttctcaacctctatattatatttaacaataattcaagatttagagcattagtaatattaactgtgttgaataaacatcctatgcccccgtatgtagttgacattattagagtaatacagttttgccctcttgacagccacagacactgttctattttaaagatttagccaaaataaagggaataacgtattaatggccacagaacattttgtagtcattagtaataaagttctgaatactacacttgttttttgaagagacactttgtgtcagtaatttctcaagataccattatgtctgtgttatttgagattaatattgtttctaagcaggttgtaatttaaaatttttaatctcttttaaaaatagtattcttagcttcttaatagcctcatgttaggtattatattaaatggctttcttaaatggctttgcttaaaagcaacatttgttataaaatagcaagatttttgcaggttaaacagactttaaatactagaaattaagaatttgaagaggttatctgtagaacttttgagtttgattaaaaacaaatattattttcagaagagacaaagattctttattgtgattcattttggaaaggatgaaaatagagtaagggaatttaaaaagaaacttgccataaacattgttttattttttgcttttatctaaactttgtgacagaaattgatttttcaatttaataaggtattgtaaagtgtacttagcactctcttgtcttgactagttgctttttattaaaccatattcataacatgacatttagagactagcacagtgaaagagtaaaatttaaccatttttgtaagatgtaatactaatcggaaatgttctcatattgtcttctgacaaagtccatggcagaaggatgagctgggttgtagaacatggcttttgtagcactgattcttcctagccttcttttcacttaggtgctaagggtcgccctcccaaagccagtactatcagccaggtgacttaacatctttctggcagctactgtctttagctttgattttttttccctttttttgttgttataatctttaatagagaattgaaagttactctttaaaatatggtttctaatctgaagcttttcctgaatcaattaggtagtttcttattgttttagtgtagtacttagtagtcagtactttgcccgcttatagaagaatctttggtttcacctattgcttggctcgattagttacttgtttcttaattatgaccctgttgtttatttttctgcaaagagaaaagttgtcatttgagtttgaactttgtcttttcccagtagtaaagttgaactttggacctctggtgaaattgttttgtgatatactactatgactaggtttagtttctttgattttactacagagtatatattcttaaaccatttctattctgattaatatacaagtagtgaattttgttctgaaattccccagactctaattgtgcagagttttatgcttcttcatacacctttaagctcatatttcagcagtttgctttcagtaagtttcagtaaattatgtgtattttattccagagattaagtatcggtacaataaatacatgaaatcattgtctactgccatatgcacacattacattcaactaccctaagcaagtagtgtatccagggatggaaatcataggaaacaatgttatagtttgtttaaataaaaaccaagttgaaacagttcctgggtaatgttaaaggtaggtaaaagtcttcactgctgactctttgggacatccaatttgtaagggagttttgttaaaatgggctaattcctagaaatacacttcctgttggtgaagaaacactactggatgctttaaaataggaaatatttatgttattcaaataaaaataatgctgtgcctttcttatctcttgaatctttttgttagtttttttttttttttttttttttttttttagtgggatatttaggatttttgatgagttttgtttaggtggttgtattatatgaggatgggaaaggtaagagaatttagagttaattgttagcctcccaggcttacaatacatttcttcgtaccttttttaaaacaagaaaatctagagacctagagattattttagaaacaatagaaaaagaagcaagccaagcccctttgctagggaaagtagcattacattttgataaaccttgaagttgaaaatttcctatttcaaattttggtagtttttttttcttttttccctaaagctcttaataactcaggggttcaggttttggattctgttcattgacaccttcaattcatatgagtaatgggcttacaccttagcaattgcaagctgatttgcttgcatgatatttgatgacttttattatatcattaacatctttgtacttaaaaaatattttctctccatcattctctaagagtactatatccaaatatctcagtatgtatatatgtatatacgtgtgtgtatatatatattatatgcatatatgtatatgtatatacacacacacatacttttgttaacttttcttgtatatcattttctagtatatcattttgggtactttattgatcctgccctcacccccagacttttataatttagtttgtaaaactttattttcctaggttgaggcattttaataattctttaatttcttgctatcttactggtacaaacaaatacttaacatttggccatttgatttttagatgattttaaattttattcagtttattgctaaaactgattttcatgtaacataactctgtgttcctgggacgtatacattatttttcctctgagatcctggcacatactttataaaaccttttgttttgagagacaaatttttgtgattttttttctgctaatttatgtaaactggcgacaaaacaaatcttctaaattcattcaagtgtctgacttatgaagtcagtgcctaatcttctcaagtgatagtttcatacagagtctttactatgtaacccctaagtgctttgtaatttttggggggacttagtgttttgggagtatgttgaaagagaatcttgtttttatggattacttcagtattatttaccaatttcaaaatctgtgaatgtcagggttgtgtgtgtgtgtgtgtgtgtgtgtgtgtgtgatttgacaaaagataagtgttttggtattgaagactagaaccgtttcgcctttaataaattattttttgtcttctgaaattttgagcaataattttcttgaaatactacattttggtagatagagtgaatgccctgaatttaaaactattgtctaaagtaagagtttcagaaacttagaagctggtgttatgagacatgtttgtagggaaagaggcaaatccattcattgctcttctagctaattttgctaacaaaatatcttgctaatattttgtttttgaagaacaactattattcagaatgttttccaagaaaagatgcatattttatttaatacagaaaaaataagaagtcctattactggcacgcattcattccctcagcaaatacttagtggtgcacccaccaagtgccagcatggagctagcactggcgatataaacatgagtcagaaattgtgtgtcttcaagaagctggcagtttagtgggagcttaatgactcattggtaaggaatacctgtagtaagggttttgcctttttcacttttctgccagtgtttaaaactctttaggtaggtcttagtatgaattttggtgaaaatgagactaactggctgcatagtgtgctattcgaaaaagtagtggagctgcattttagaaaggatttgggttctcaagtcatcacaaaaagagggaaatcaaatataagcaaaactgtcttttcaaaaagcccttaaattgtgcataaaatactatattgtactgtttgtaggatgagtccaaatgccacttttccacccatgttggaaccaattgcagttttttggtcgaataccagaagaagtaatttgcttgcattaaaaagatatgttttacaaaaaaacttttaattctaagaaattatcctcatctaggtatgtacagtgaatttatggaaattaaatgtgtacatgaagtgaaagaatgatttcttttctttttttctttttaatatcttggtaggatccacgccatctgcccttgttttctgacttgagtggttgaggaatgaattgtgaataattttgaacttgtttgggttttgaaagatgacagattttggttgagtggaattaggatctttccagtagtaggtaagaagcagaggaggagaaaaacacagggcaaaaacgttccatacagaaaggtttacagtgtggtccatctcaataattttgtgtgtgtttgtgtacaagggcacaaaatccacattatagaataattggaaattattttgtacaagggcacaaaatccacattatagaataattggaaaatagagggaagatcatattaattgtttaaatgtataggtagttccattatgaatagtctcctgtaagttttttttaaatgtgttatctcctcgaaataatgctctaaggtgcttaatgctatttctgccttcagcctcattccactcataatgttatactatgaatatttttatttaacccttaatgtaccattagttctgttctttatggttaatagccctatttttgttgttttggaagtctagccagttttatgggaaaacacaatttgctagcctaggaaaaagggaattgaaaaatatattttcatcttaatcccgccttcccttttgttacagccacagccgactggcttccagtgagaagggtggcatcattatatctccattcttccctgaaccctagcaatttatcctgatgcagccactcagctgcattgcagtggtttccaggagcaacccacttacctgcagcccccacccatttcagtcatcccaacatggccaggggaacatagattacattttgaggaccataatttgacttatgacatatctaaatacctgagaaaggacacgctgtccttataggtgattaggtacttgttttattaacacatactgagagatattgttttagagactctgtatgggttatgaagggttaaacttttttgccataatttgtttggagtttagggtttggttttaaaaaatatcatgcagtggtaattggaaaaaattttgtttcaaatttattaataattaagatcttttctatttggaggcttccctttttattgtcttgggtatacaatgtgaacggtaaccgatctacttaattaaaactttctggcattttagcctctttgcttttgctggtttttttgcacataatttgaaacacgtaattattattttctggcttcaggggagtttgtgagaggcaagcctgtatctcgttgttctgattgggaattacacatgactatgaaaaatgggattttactatacataatggcatttaacagaagtagttttatgaaaggaaaatatcctacaaggtaggaaaaaaacaagtatttattaatgcttcattttctgaacttaaatagaattaagctaaattggctttgctttttcctccaataaaataacttttaaaaattcactttaatggagtagttccagagatatattactctttggatatggttatctagtttgcagcaagtatcttgtgatatatagcttagatctcagcaggaaagaaaaaaatcttaatttacatatcagtttctgtatttgtaagaattctgtagcaagtgacagaaacgctgttgagattaatgtaggctaagaagaaatttattgacttacatacattaaaatccaggcatagatcagtaacagctaacttctgttctcaagtgttggtcattagaattattatttggttctcttttcttctgggttggattttttctcagctagactgtcagtgtagcggtgaaggtagctctgaaccccgaagtcatacagggtccttaaagcttctcatctttttggagtctaataacaaatctcatgcagggactttggccctgtgcccatctcttggaccaattattgtagagagaggagaggacaatgaagtgccatgattggtcaggcgtggggacatgtctacccttgcagctgggtataaatagcataatatgattaataactgtagcagaaccccaagacgtaagggagggggagttcctgaaagggtgggatgccgaggaatcaatactacaggaaatgatctcttttaaaacatttaatctctcttacttggaggccagaagtagtacacagttgtcataaaactatcatttttagaaaaacagatattggctgtaaaccaaaactgatttgatttctaggcactgcttttactcaaatatttaaataaaaaattgcttttatttaaaagttatttctttaaaaaattgaaatactgataccttaatgtgcacaatttaaaagtatttcttgtaatttttatttaattttctttaaaaaaattaaataagattctctaaaatcaatgctgttgatttttagggagatggaatactttggaagattaacagtctttggcattgagaaaaatattattagcctagttaaacaattacgtttttaaaacaattttattctaccattttgaaaatgaaattctaaacgaattactttccaaggtgttttgcttttaaaacaatggtctttttaaacacaaattgagacaatgtcattattgtagtatttctgagggctccctaataatactttttaaccatgatttcgtggaaattatgtgaaaggaactacttcactgactcttatataaaatgggtatataagagttttgaaacattacttaagtatggtgtcatgtggtaactgtttaattaccaaaaatgttatttggcagatattgcaggataaaatctgatcccctttttaaagttttttatagcctccactgggagaacagaggtactcagagcaggggtagacagttgaaagagaggggtgggtgctccaaataacatttcatactatttttatattctattactgtatcaatgtcttcagctttggtgccataaaaataataattttagtaataactttgagtttatatatgccatgcacagtaggagttttgtagttttgccaagtgtcatctggtagttggatctttagtgaatattaaatgttggtagattattggtgaatgcacttactgtacataaaaatgaacattcatggaattgggtgtgatttgccagtaagaatcatcatagcaagtactttgtattgttagattagtttgggcacccttcggatgactttagaccatatttggaaaattactgcttctacttcaaaagcctgtaataattagagttctccaatattaattccatatattgattaattaagccatgaaatctagtaaaatgatatagtctttattacctctgttcacagaattgtatctcaatccaacttggtagctttcagcagaacactttgtcaaaatattattaattttagctaagaattctattcactaatttcagtgtttaagttagaatgcacatgctagtgaaaattttaatttcctttgaatagaattagatttgctaactagagcaatctcacaatgtaatgctgatgactgaaatgacacttcagcctcccttgggtgacaaccctaagtttagacaaccttactctaataggaatattgaggacttatcacaacatattagctgtcatttagagtaataacttccatgtcagggcattttatacctgtcttatttggtttataaggatgtatatattagcattcatgttttcttataaagaactttatatatttttattctctatgagtcagatattatcatcttcctttacacatgagaaaattgagttagagagattaacacgtgaaagttcacacagactcacaggaagaattatgaactgacacagcgttgagtctttctttactttctggatagaatattagttcattatatccaaaaaacctgtcttcctttttctagtaaaaggaaaaagcacaattctgaattgtttgcgtgggtgttaaatgcagtaaaacactgggcaagtacttacaataaaggcttcactgcttggttctgtttcaaaacagagtttgtggccgtgcagtttaatctgtacagctaagctgcatgataaagtagttatttccaagaattgctaatcaagcagaaagttagtattcttgctacatttgtaagagaatattttcagcagaatatttttattgcggaaaatattctctataatatgtaaaagcccagataaatatattagatacatattttaggataaatatacttgggaaaattgcatattagaaataatattttgttcttgtgtttcctttctacttcctctgtaattcactcaccaggaaggtgttagcacatttactgagagcctagaaaatgttctggtgaatgtagaaaggaacgtactttagaattagggatcttttataagtatgcagacccttctcacaaaagtacactttgcttgaataaaatttagctaagctaggtaaaagaataactcattgcatttaagtagacctttctccttctagacttcgagtattgcacacctaagatggatcctttgaagaggcaggtaaagcaggttgtggattgttggaacctcttattctttaagtgtttacgctgttatgttttctctctgggctaaagtcagtcacttgagtggaaggaaacacagcaatccaatcttagtatatggataaacaattcgaggcttagcaatggcagaagtcatagcataagcatggtagagcagagactagaactcagattgtttagttcctttcattgttctagtttctggcataagaatttgtgtagaaaattggcgaaaaaaggacctgttaaacatattctgtttctttatgaaatctgcattctcttggaactaagtgtaatgtgctagactcagtttgttaggccatcagtgtgcatgaatgtggttagaggcagtggtatccccgaacctgcagcacaggaaagaattttaatcattatatgccatggattttcagggcattttaagcctttataatggtgtaacttatgattaagatttacacagtcaaaattgttagctggtataatagctgaatagttaagtatttattttggttagttactttagctttagctttgaaaaatcatttttcctatcggagattcttcacaatgctttcagtaaaatgtttctgaatagttcctgctatatggtagactgctaacactgtttcttgctctctctgtggggctgatgctacaagtctgatttagagtcagctgtgcttttatttttttccttgagtgactaggggatgcattgggggaagataaattttagggcaagaggacactcagggttgtgggagatgaactgtcaaggatacctttggctcactgtcctcaagcttgttcggctgcagtgatggcataactgagaagagggattgtgctcttgctgggtgcgggacaagaagatgtctcaggccacgtaaagctggccacagcagaggacaaggtattccctgtgaggcaaaactgaagaaaggggattgaggtggcagttctggggaaactatgtttgttaggtagactaatgggaatgatggagtcttgcttgggctctttgtaggtcagtggaagaacagcatgaatgtggacatgaaaaaatctttctgcaatccatttaccacatactcctttgcaatatcagtcagggttcagtgcaggaaacagaaggggatataatgcagggaattaattgcttagggaatcttttgaaagggctggagggctgggctctagactgagcctctgagaatgatttccaggacaccttgaaacagtccacagtgggagctgccacctctgcttgagtcaggaaagtggcaatcaggaggttgctactgaaacagtggcaagaaaatgctactgtagctgtgatccaggtgatcagggcagccactgctgttaacattgtaactgctggaagtctggaatgtaggatctggccattgctgtgacagcttctccttgatgctcgtgaactggtgactagatgctgttatgatgaatctggtccctgctgcctttgccattgtctctaaaataattagaaaatgattaattatgtttttaatataatttaattgtaattttatgcaactaaattcttaatagtggctgtgtttgacaactgatttgtgaaattcataaaaatttaataattggccttgcaagagagtacagccaactccattgcatcactgtaaaacctcctagctgacggttctactccttaattgaaaattctctcttttttgttttagttcaaagctggagactggatactgacatgttcatgaccttgtgtacaagctgaaagctgctgaaagctacaggccaatggggctctgctttacttctgccttccatatcttgtgtcctgcatcttaatggtggaatcagatttgcatccagaatactagctataaaggagtctggaaaagacagtttttagttttccaacttctgcgtttcaggaaggcatactacaaggaggaagtcgctgagtgatagctgatcctttcccaggcactcatcttcttaaacatagtatattaattacaatttagcccattcttgatggctcattgtcatttctgtgagcttctcttttcataatggcctgtagttggaataatcatagggccaagggattttaacatctgtagtaactttttgtcctaggttagcttgtatctctcccacctcccataactgctgctgagacatctatgtttgatatcatttgacgtcaacctcccctgcaagccacaggcagggagagcacctcacccaaagcaaccagtttattggctggtcagcaacctgtgatttctgtagcttaaaaagatgagtggggcttattgtcttttgaactaagacaaaaaggaaagaatttccaattaagggtgggagcttcagctgagaggttttgaagtgagttggctgtattcttttgcaagaccaattgttaaattttcaagaattttgtgagttgtcaaacagccatttttaagaattaagttgcataataatttaataaaaacaaagataaatactcaaaacaaattatttcctaattatttgcccacattttacaattatctatgcttttgaatttctttatatctactatatctgtatggtagaaacactatatagtggtttgctactgtgcatatcttcccagctcccttttcactgttatcacagttgactatggtggtagttgttggcatttcctgaacatatcacactgattgtgggggcggggagggagaatcaaagttggagaggtcatgagaaaccatgtacaaactaaaattatgggagaagaaactatgagtgaaacgatgagaaaaacctaatgcatgatgtagaactgagtggtgttaatagcagagcactggagggaagggccacaaaactcttcaccccaaggtctagaatcattctagaatcatcctacaagcctagttttcatgagattcagccctattttatttcttgctcttggaattatatgaaattacgaatttctgtgtgttgccagctgtaatagaataccctggaattttatttacttttaattttgtttatttatttatgcttatgtgccatcttctcatgaaaaagaggcagtatgttaaaagtttgagttcagattttctgatgtagataaataagctaaagaaggcagggtgaagtgtgatatatgagaatttccagagcagggtattcgtaacttgtaagtatttagtccaagttccctctcccaacacattttacactagaataagattgaaaggccagatgtggtggctcacgcctgaaatcactttgggaggccaaggcaagtggattgcttgagcccaggagttcaagaccagcctgggctacatggcggaaccccatctctacaaaaaaatacaataaaaggtaactgggcatggtggtgtgtgcctgtattcccagctacttgggaggctaaagtgggaggatcacttgaacccaggcaggtcgaggctgcagtgagccatgcttgtacctgcatactgcctgggcaacagagtgaaactgtctcaaaaaaaaaaaaaaaaaaaaaaaaaaaagactgaaggctgtcttgaggaatgccacttataaatacatttttaaaaattcagtaatatttttcatgtataaacattgtggagactattgtagttgcttgtacaatactggggcattggtgatatctgtctctttactattgtagctcctgcctacgcctttagtaactgctaaggtgcagactgtagatctggactgtctgtgtctgtggctcacaacctcaacttctctgctgcctttgatttgctccctctgcagttttgttttctctgtactccgattgcttctcccatgcttctctgctttccaaagaaaaaactgaccttgtatagatcctgtcagctgattgcagtgctcttaacttctccattgtgagttgttcagtctgaggagttaggtataaacccagagtggtattctcttttctgttgtgtttggttttgcttacatattcaggagctgctctttacccccagaacatccgtatatatgtttttttctgtttctagatttaaaaatattccagaagcctggcctcaagatagataatattttacttttaatttggtgcccttgttttagagatttgaactggattgcatttagtaaaccaaaccccatctttaaaaaaatcatcttaaaaaaaaatagtgggccggacatgatggctcacatctgtaaatcccagcactttgggagactgaggtgggaggactgcttgagcccaggagtttgagaccagcctgggcaacacagtgagaccttttgtctacagaaaaaaaaaaaaaaaaaaaattagccgggtgtggtggcacgtgcctgtagttccagctactcaggaggctaagataagaggatcacatgagcccaggagttggaggctgcagtaaattatgatcgtgctactgtactccagcctggatgacagagcaagaccctatctctaagaaaaaaaaaaaaggaaaaaaaaactggttcaaattggatttttctattctttcataagatgataaatgaaaaaaaaaagaaaatagatttttgaaaagcaaataatctcttggaatttcttattaaagtataaaaaattatctaattgaggcatgttaatccaatattaaagtattaaaggctgagtgtggtggcacaggcttatagtcccagctactcatgagatttgagaccaggtgaactgcctgagttcaagaccagcctgagcaacatagtgagaccctgtctctaaaaacaggtaaataaaaaaaaaaatttcctctgattacaggagataggtagaaaaaatgtgttacagtgcagatgagaatttccttagcacttttaatgtgaagtttatttagattgggtggccagggaaagcatccctgaggaggggacatgtccattgtgagttgaatgactgggaggcaggcatctgccctctgaaaattttttactcagagagaattgtaaaacacaaatatgagaacctggttcgatataggaatagaaaggctgatatggctggcaccaactaaatgaggggtgaaagtgagagggatcagattgaagaagtagacggggaccagtgggggtctgttagccacagtaaggggtttggattttatttattcttaatgccactggaaagtataaagttggagaatgattggtatgtatgtcaaaaagtcattgtttgtgatgtggaaggagggcaagagtggaagaagggaaaccctttagtttggatgaaaataaatgatggcttggacttataagaatagtggcagtgaaatgaagtggatagatttgagatatgtttttaaagaggaactaaataagacttaactgattgattgcaggtaaggaagggagaggacttcaagagaacctctaggtttttgctttgagtaactggtggtggtactatttccaggaataggaaagacaggaggttgggtggagtgatcagattttttgtgtgaaggagatatatctaccaccaagattattttcttaactttttactgtacttgctttattatacattaacctattcctccatccatcaatctgtcttttttttttttatgcctttcaatgtaaattgcaatgcatttccacaagaaaggcttttaagtgcccagtttttctaattttacagatgagaaaactaaaccttggagaaaaatatgctcaaggtcgtatagctagttactggtgaatctaggatcagcatgcaggttaccattagttcaggactctaatttgattatattttagcttgtaagaataaaagtgaaatttggaaatgggacaagttttcccacgaactcgtttatgtgctaaaatatcttagacccaaatttctatgtcaaaaatgcaaaagatgtagtactacagttgcatttgactggattacaatgttagcacggcacttaggacttgttggaaagtaccttctaatgttgtagaattggaacattttcagatgtttggttcaggaaggtagcttgggattcttccaagcattaatcctcttattggcaaggcatttggattttaattagcaaatgtgccttgcatacctactatgcactaagccccatgcaaggcccagataccataaaagagaatgattcaagttccgtacttcaaagtaattcagcctttgacttctgtgtcaattttctgaaatttctctttttttgctgtatgtttgtttaaaaatataataaaaactgaagttcagaaaggaagagaagcttattcaatctaggcaaaacttcagcctccttgttaaaattttatgcatatgactgacataggctactgaattgaatcaatagctagtagtgtgaagggcaaacagatttttcatttgctttgtgtaagcactttattttccaaggagtgaaaataagctgttttagtttctgtcctatggaattaactagctaggttatcagttaagttggtatccaacctggaagttaatgacttaagttggtacagaaatatgagacatgtttgtctttaaaagtcaaactaattgtctgtctttaaaagtcaaactaattgtctcatattgatattatttttatgctttcttgtaaaataaacattttcactattgagctctgagaatttggattttgaggaaattaacccaatagagcattatgttctttccttgaagtggtcattctctgttctaaaatttaatatcctccaacaactctctcagctcatatcttcccaaactcatttcccattagtacctaatatgaatactcagttacagccaaagtatttgttacacatcttcaaaatccagtcctaaatttatttcctttagagatttttctaggattaatctattactttttatttctgtatttttcacccccaggatacctaaatagttctgtactttgccatatattattattaattttatagctatttagtgcagtaatttagacctacccagcagactgtagtgataaaattgatctatttattactgatgctgaaaaaaacttagcaaatttaagttaatctgtaaacactttctatactggaaggcatctttatacctttgacaagaagagtttctctttggtggaaagtttcaagaggaacacacatgggttaaaaaaggatctgttctttttttttttctttttttttccagttcactctcccaaatttgacaaggaaaaagagaaatggaatggaatttagttccttgttagtaagaattagaaaagtataaaggtagaggagaccaaaattgacatcaatttgaatttatttgggatatatctttcaactagaagtttacttttaaaaatcttctctttttggctgggtgtggtggttcacacctttaatcccagcactttgggaggcaagcaagaggattgcttgagtccaggagttcaagactagcctgggcaacatggtgagaccctgtctctacaaaaaattaaaaaattagccaggtgtggtggtgcatacttgtggtttcagctatatgagaggctgaggcaagagaatcacctgggcccaggaggtcagtgctccagtgagtcatgttcaacataggtaagattgtaaagtgaaattaacatttggtaccttgttactttttttctcctatcccattctcatttttacttcttggtattacttttctgtgtctgcacactgtctcctgactgtctagtctcagcatcctttcttattggcacacactatcacttggcatttttccattgtgtaataggtgggtgtcaggaaagttatttgattaatctgttctatactaggttatactatactgatgtgaggaattatcactgctaaacctactcagggatattttcctcttaacttcctgtgtgaccccaaataacagaatttcaagcaaggctgtaggaacttttctgcaagtcacgccgttaaacgtattctgcctaatgtaaatgattctggaaagtatgaggaagatgttagtggttcctagcctcgtcttttatcaccacatttcttcaggcagctccacttctcttgcctgaagatggtctttctccatgtgttgtttttctctgtgttcttaccagagtcctctgtaacagtattttgttgttcaaaataaattcattacggaataccctgcattttgagattctttgtatatactgaaatataagtcagcttcatcttttctgagtgacaattcttttgaggcattgggaagcctcttatattagaagaaggtctagagcctggattttggttcttagtcctaaatttgaatcctaggtctgccacagttctgtattcaaaagttccataaagaatcaggacaaaaaattgctactaaccatttaccacccagaagccataataataattaattttatttttcttttactattttaaattattttggctgtgaccgtcctagacgtgtgaatacatggtcaaaaaatgtgaactttttgggagatcttgataatgttacattgtatctttctggctctagagctcttacatttttcatactaaattgtctcagtctttggggctttattattattattattttattggcagtgttagatcttgtagccaaaaaaagatttttttttcctcttttggttccaaatagtcatctgttattttggattatttgctggattgttaactatacaggaaacttccaggcctcatctcacagcaatgactgtcatgttgataaacaattatgatatcccaggttatgttaaccctgcctaagtagttacatggcccagtgaggatgcctagtagctataggtgattggttctgttttgtctcctacacctaaaattttgccataggtaactgttttgataaacataggatagcgtccttttattctgtatgtaaaaaagtactatatgtaaaaaaggaacttaactcctcactaccctgtttctgtcctctagacagccagatggatcttgtgtaaaagtagaagtaatcttggctatagaacaagaactgttgatatttccattttaaaaagttgaatcagtcttaagtttgagttggtgagtaaaacaaaaccaaaaccaaacctgggataagctaccaataagttaccaaagtatttaaaaacttgacagatgtaaaacattaatatataatttattcttagcaacttaatctgtttattgagtggcagtgtttcagtaataaagctgagctatttggatacactgaccttaatctagtggaaaacaggaggcttttaaattggcacatacacaaatcatcttaggatccataaaatgccttattgttaaattactgtttttaagtcttatattttctctgactacttctgatagtattagtaggcatctcttactgtattttttttttcagaaggcaaatttaggccgtttttataaggtgaatataggtagattttcatatgtattctggtatattgggaattactgccaatgattacttcccagataatccattctaactatcgagtatctagaaatgatatgttttaagtcacgatgattattaaaaaactgctgaattaaataagctacacattttgctggaaattaaacaaaacttactcgcttctttgaaggaaattgatttattccttgatttcttctctgaatcttgaatacaaattaattttttggttttttttttttctataaaagtgaacttggagaccagtatagcacaatataaagcaaggaaagttaaaatcaattaagaatgctttgtttaaaaagagagaagacagaaaatgtacaatttgtttgtgaaagaattccatagaaataacttatttatttatttattttattatacgttaagttctggggtgcatgtgcacaatgtgcaggtttgatatataggtataaatgtgccatgttggtttgttgcacccatcaactcgtatttacattaggtatttctcctaatgctatccctctcccctccccccacccccgacaggccccagtgtgtgatgttccccgccctgtatccaagtgatctcatggttcagttcccacctatgagtgagaacatgcagtgtttggttttctgtccttgtgatagtttgctgagaatgatggtttccagcttcatccatgtccctgcaaagttcatgaactcatccttttttatgactgcatagtattccatggtgtatatgtgccacattttcttaatccagtctatcattgatggacatttgggttggttcccagtctttgctgttgtgaatagtgccgcaataaacatacgtgtgcatgtctctttatagtagcatgatttataatcctttgggtatataccaagtaatgggattgctgagtcaaatggtaattctagttctagatccttgaggaattgccacaatgtcttccacaatgattgaaccaatttacactcccaccaatagtgtaaaagtgttcctatttatccacatcctctccagcacctgttgtttcctgcctttttaatgattgccattctaactggcatgagatggtatctcattctggttttgatttgcatttctctgatgaccagtgatgatgagcattttttcatgtgtctcttggctgcatagatgtcttcttttgagatgtgtctgttcatatcctctgcccgctttttggtggggtttttgtttgttttttttcttgtaaatttgtgtaagttctttgtagattctggatattagccctttgtcagatgggtagattgcaaaaattttctcccattctgtaggttgcctgttcactctgatggtagtttcttttgccttgcagaagctctttaatttaattagatcccatttgtcaattttggcttttgttgccgttgcttttggtgttttagtcatgaagtccttgcccatgcctatgtcctgaatggtactgcctaggttttcttctagggtttttatggttttaggcctaacatttaagtctttaatccatcttgaattaatttttgtataaggtgtaaggaagggatccagtttcagctttctgtatatggctagccagttttcccagcaccatttattacatagggaatcctttccccattttttgtttttatcaggtttgtcaaaaatcagatggttgtggatgtgtggtattatttctgaggcctctgttctgttccattggcctatatatctgttttggtacaagtaccatgctgttttggtcaccgtagccttgtagtatagtttgaagtcaggtagtgtgatgcctccagctttgttctttttgcttaggattgtcttggcaatgcgggctcttttttggttccatataaactttaaagtagttttttccaattctgtgaagaaagtcattggtagcttcatggggatggcatttaatctataaattactttgggcagtatggccattttcacaatattgattgttcctatccatgtgcatggaatattcttccatttgtttgtgtcctctttaatttcatcgagcagtggtttgtagttctccttgaagaggtccttcacatccctggtaagttggattcctaggtattttattccctttgtagcaattgtgaataggagttcactcatgatttggctctctgtttgtctgttaatggtgtataggaatgcctgtgatttttgcagattgattttgtatcctgcgactttgccgaggttgcttatcagcttaaggagattttgggctgagacgatggggttttctaaatatccaatcatgtcatctgcaaacagggacaatttgacttcctcatttcctaattggataccctttatttctttctcttgcctgattatcctggccagaacttccaacactatgttgaataggagtggtgagagagggcatccctgtcttgtgctggttttcaaagggatgcttccggttttagcccattcagtatgatattggctgtgggtttgtcataaatagctcttattattttgagatacgttccatgaatacctagtttattgagagtatttagcatgaagggctgttgaattttgtcaaaggccttttctgcatctattgagataatcatgtggtttttgtcattggttctgtttgtttgatggattacgtttattgatttgtgtatgttgaaccagccttgcatcacagggatgaagccaagttgattgtggtgcataagctttttgatgtgctgctggattcgttttgccagtattttattgaggattttcgcatcgatgttcatcagggatattggtctaaaattctctttttttgttgtgtctctgccaggctttggtatcaggatgatgttggccttataaaatgagttagggaggattccctctttttctactattgaaatagtttcagaaggaacggtattagctcctctttgtacctctgttagaatttggctgtgaatccgtctggtcctggattttttttgttggtaggctattaattattgcctcaatttcagagtctgttattggtctattcagagattcaccttcctggtttagtcttcggagagtgtatgtgtccaggaatttatctattttttctagattttctagtttatttgcgtacaggtgttcatagtattctctgatggtagtttggaatacaaattaatttttaaagaatgttgagtcttctattttattttataaaaattacaaaacatgatataaaaataaaaaataaaatagttacatttactacttagtattaataataaaactgtttggtgggttaatttatttcaatccaagctaacatatattactaaagcagatttaaataaatgatgcttatgtgtaagacactgctggatattataaaagactttagagttccttttatacctgtaacactaattccaattattatgtgaaatttggtatataattttcctaatgagatgacattattatcattacaagtttcacagtatttgtataaatgtgttactagaccaaataatgtaaatctgaggcaaatctttgcatttatagaaactagagcaactttaaattccagatcctcttccctataatgtttttagtagctttcttctaagtgctttgccagtaggacctttagtagcagaagtaatactaataaagtaagcaattatagttcaagcagtctttctgccaaaagttcattcacatttaaaggaaagtaggaatgttgggtgtttttgaattgtctatgccattgctttccagactgattaaaactggcagaaattactcagatactgtgaggatgaattttgtaaccatccccattccccacgcctgatagaacatctaacactaattggctattttcagaggtttgtgtataccagcaatagttgagaatgaatagtttctcctttttttcctatcactttctgcctagattgctttgtgatggctgtgatcttcctttgcctctcttttctatctctccgctcctattatactccagccccaatatgattcttgagcatcacttttgtttagtcgttcctgtttttttccaaatccatgatgatatctcctattgccaactaaaatcttcagtttagcatgcaaatcttacaagtgtggacccagcctactcttccagcctcacatccagttattctctcctacaccaatgacaatggtctgtttctcaccagaatatgctttgtacttctttttaagcttcaaaagttttagtatgttatctccttactccctctcccaatagctgcaccttctgtagtctttaaatgagtgcgttttatatttataaagtcgtactgtatatatagtattcggtctgattatggaggatttgaaagctagtcagatcctaaagctagtgaaagtagccaaatgtttttgagcagggggtcaaaaacatttatatatattaattatataattaattacatatattaattatgtaattaatgacacatattaattatgtaattaatgacacatattaattatgtaattaatgacacatattaattatgtaattaatgacacatattaattatgtaattaatgacacatattaattatgtaattaatgacacatattattatgtaattaatgacacatattaattatgtaattaatgacacatattattatgtgtaattaatgacacatattaattatgtaattaattacacatattaattatgtaattaattacacatattaattatgtaattaattatgtaattaattatgtaattaattatatatcaatcatatattaattatatattaatttatattatattaatatattaataatatatattaattattaattaattaataattaataattaataatatatattaattatatatgatttatatattaattatatataatttataaatatattaattatatataattaataagggaatatgtgattaatctggcactgatgtgtaagagacactagaagagttaaagattagcgtggaaaccattaaaggaagagtcaaatttcccaggataggtagaactgatgcctgggatgaggaagagatatcaggtatcaaagttaacaaatcttgagatacagataatgacagaataagggagattatgaaggagagctggttttaaggaggaatatgatttagattttaaataggtttggttgcaatgatgatataaatatggacttcagattagaacctgagcattaagacttatttctcaaattcagaatggaatgcttagagttctattcaaataaaaacgacaaagttgcatatttattaagaaagtatttgttgctgggagagtggttataaataaagtactataaatagtaagggtgatattagcatatactttgtttctaatataatattaagtaactattgaatcacctttgactaattgtcattgaattagcaattagtaattgattttttaaaaaacttttattttaaaatttcatttattttctttttttcacttctccattgttcttttagaccttttttaaagtgtcagatttattgagtataatttacatacaataaaattcatctattttaggcatatggttatattagttttgatgaatgtatagagtcatataatcactatcccaatcaaaatacagatttcaaaaatcccccataaaattccctggttcctccctgtaggttggtgatcttttgagaatgcaatttcaccttataatgtatttcaacgaaataaaagttttcagttttaaacaatcaaattattatagaagtggattttggagtatagccacgtcttaaattggggaccacatttattgatttctgatagattaatttttattttcagagacagggtcttgctttgtcacccaggctggagtgcagtggtgacatcacagctcactgcagtcttgaactcctgggctcatggtagcttaatttgaatttcttgtatttaactgagcaatttaagaacaggacttaatgtaaatctacacttttactttcctactccctcctcccctatcctttttcccatttaattttctgcctaaaatcagtttcttctcatgatctctgtgttgggctatgtattcctcctgtatatgtttcttccctcattcatagcatttatcacactattataactgatagttacttgtctgtcccgttagtctgtaagtctcactgaggtgcttcattgtcttgatcattatttgatccctatcatctaactcagtgattggcatagtaggtaatagatattttctgaatgtgtttttcttgtcacctagactcaaatactttagaataatattagactctttaaagcctcttcctaaaagaaagaaaacctaattaccaagttttatcagtttttctttctttataatattttttatatcctcatccattcatttttattttcatattcacttccttgtctgggctttttcgacctaagacctggggtccttggtttcagtcttttgtttttgttttttatcttgtatactactgctatttcagttttgtgtaaatttttctcttattcagaaagctcagtgggatctgtgttgtttaccacagaaaatgtaaacttatgtgtctagcattcaagacctttatcatttatttaaaaggttttagtgtctgataacttcaaatgcactgtgatgggtgatttgttaggctgtgtagtttgtccccaacccacttttcctgttatctttttctacttccctacttgaaattttccacagtgtctaatttggttgcttacttttctctgaacatgctttttgctttccagccattacttgtgctatttcactaatctggtatcttcttcttttccatttctttctgagtcttacccaaatcaagtcccaccttcaacatctttgaccattctattccatagagcactcccttttgacctcgtttaggggatttaactatttatgctattcatttgtaatactgccttgtagtcttcttctttctctttttttaatttataaatatgccatcttcttacacaagatggaaagcacatggagtttgaggaccatttcttacatgtgcttgaatctcctgctgtctttaacatagggcttgtgcctagtggtcctcaataaatatatatttgattagagtatttagacacctgtttgcacttatgtatagaaaattaatgagagaatatgatagtgaatcattttatatctgataaaattccaaaatataatgactagtacactaaactttagcatctatgaacagaagtgttgtagaacaactttaaagattttaaagtgaattttacaggaacaatatatattacagtacatttatcaaacacttatttttttgctacatcattgttttcctggaagaaattaatgttggcagataaagctattatataactaaatattttgtaaaaacatttggcttaactaatgcagtacttgtttaattgatttttgatttttataattcttataatgtaaatagtttacatgataagtaaaagtaaatatagagtttagggggcccatttttaggaaattttaatcatacacattatatagggattttctacttttatcttcaatatccacattagctttattaattaaggagtcatatgactgaaagtctcaattgagaagtcatttatcgaatctacattctgtactcttaaatccttatagatgggaaaaacctggggactctacaggttaacttatatttttattactcagtttgggaggaatagaggaatgaggcctttttatcttttagaagatcagaactgttcagagttctgaacagttgtttcatttcaacttgatattgagcagtgaactttgtgattatgcttggtgagggcaagtaaaccaaatggatagggctttaggcatctttgttggagagaaagtgtaagaggctcttttgggctgggggtgtagagtgcagggctaggaggaagagaaagcatggagttttagaaaaaagaaagattgggaatatcccaagagcaagaccttgtatttttggagagtggttggagacatctttttcttcttggtttgcaaagagagtgattggtttccattactgctgtaacagattcccacaaattcaatggcataaaacaacatagatttattatcttacagttctggaggtcagaggtctaagtgggtatggagggctgcattccttctggaggcgctagggaagaatccattttcttgcctttttaagtttctagagcctgcctgcattccttggctcatggccccttcttccatcttcagagcgttatcagtctagcctctccttccgttgtcacatctccttctctcactttgaccctcctactaccctcttagaaggatctttgtgatgatactgtgcagtccaaagggatagaattagaatttgtgggtggaaattacagagacagatttgtactcacattaagggagaactttctaaccatcagctgtaaggatggagtgggcagtctcagaaagcagcagcatgtcctagacattggcagtgttgaatagaggatgaacaacctcttcccagaattgttgtagataggatctataaacattggtgggtctacacgagccttagacccttgccaaccctgagatcaaatgattctctatgcatagctcagtgctattataatttggatatggaacaatccctgccttaaggaattcaacttttactccattagttgctgtattgctttattgccccctttcaatacaacagtaaacataaggcctaaaagaaagactgaaaacaagggctgtagatttaggaacctactgcttagacaatcaaacctacttttgtttgatgaagttcttttgggttaaatatattttcacttgttttgaatgactcattcttccattcaggtgaaaaatactcagactttttaacaatttgaatggatggcattcctaaaaagttatgtggaaaggagtttgaatatttaatcttacacttttccaaataggagaaaaaaaattttttggaatttaacaggcctatgtgaaggctttaggtgaggaacatagcgtccgttcatctgtgttgaatatttcatggttttgattataaccaaccaatatgaaccaatttcagtagttttagttgagagatctagttagtagttcactttcaggtagactcaaaaagcttttctgtatctcagggaatacaagtcaaatgtctgtacatggggggagtggcttttataagctggtagtcagtgaatattgcattgggagagctgaaaaagtttatgtactttcagacatctcataatgtattatgtagcaaatttgttttctccatacgtttttaatgaccttatagattaaaactttttttttttgagagggctaactgtatttttttcttgaaaggtatttttgctgaaacagagtgaaattgaacatattttctaaccagtctggcatagtgcagcatcatggtatttaccttttttccctgaggctgttgtgcctcatgttttctatttaagtatgacttactaatgatacacaaaaaatttccatggtttctgtagcttcttccttatacttcaagcctgtcccacatggtaaatatgcttaagggtcctcttagataaatccaatgtcaagttaaaaattttgtgctattcatttgacagtgaaaaagagatagtcccatttgaggatatgaccagagtataaatcattaagtaatagtattagaaagggctttgacaagttgtctcatctaactctctgctttaaagaggcaagtgacctaattcgttagtttcctcaaaatgcagactctaaaccgaggtttcataaaatccaggctttagagccttcaagaaccctctgaagctgcatgcaaaatttctgtgattgtgtctttttatgggatgagggtccatcaacttttatgtattcattcatgaattattccctacctttcttcagtattttaataaatgttatgtgaagcttgtaccaggtacttggaccatactcttaatatatgattcttcataaacttgatcttttgttttatctacagccagtaggaagtagccaatcttaaaacaaggaaccagatataagggactatggctctgtaattacttctgtatttgctttgaggtgtatttctggactgctcttggattcttgctatacgctaatgtctgaaaccaccttgatttttttttttttcaatctatatgtgtttggatttggctttgcttactgattgtctgatgtggaatttggtgacctggatgctggactgagtgctttcttagaattcatgttgtttttggaatttcacctcttatcattagtgtgaactgactttaaaactttatgtaaaacatgccctgcccatctctctctctttacccttttactgactgtaagggagtaagcttagatagcaattcttgttttttatttaattggaacttttattgagctaactaaattcacatgtagttataagaaataatagagatcttgtatacctttcccttagtttgcaccaatggtaacattcttacaaaactacagtataatatcacagtcaggatattgacattgataccaccaatcttaacagatttccctagttttacttctattcatttgtgcatgtgtatgtgtgacagcatccttagggtgttgcttcactagccggaaacttctgtgccggtggcacctctacttgagttttgctcgcacctgctgggctcgttctgcccacttggcctgtcaggctgcgtttggctcatgatgcctgcccggatcccatacctgccaagggtgagccaggacagagcggtgaggggcatgtgagtgagcgagtgtggggtctggccactgcgcacagacaggcatgccagctgctgcggggcagggtggcggggcaggcagctcccggcgctggcacaggcgcctgctccgtgcaagggtgcatctataccagacataccgcaagcagcttctgctgcgggcactagtgtctggataagggaacgtggtggcgcctgaaagctgagagataccaggaacagcagaaccctattgccctcagtgtggcgagtgggggaggcatgtttcggggggcatgttttggcccaattgtgttatagctctttcagtctcactacccagctctggcttgcagctcctgggctgatccggccccaccgctacttcccattgcatgtgtggctgcctggtgcggtggagggcgggagggctatagtgttacagaaactctggcttggggaatcctgaggtctgggcccccagaagggttgccacccttcacttctgcagtctgagagtatgtcactgcccacagcttggtgagccgaccaagaatgtgttacatacccctttggctcctgccattcagtaggtcctgagttcttgtcccacatccaggaagaatgagattatgtggacaactagaggatgagcaaggcagagaagaactttattgagcaacagaacaactctcagtggagaagagacccaaagcgcgtagttcctatctgcaggcaggttgtcctggtaagtattcgtttttttttttttggggggggggttgtttttgtttttgtttttgagacgtagtctcgcacttttgcccaggctggagtgcagtggcctgatctcagctcactgcaagccccacctcctgggttcacgccattctcctgcctcagcctctcgagtagctgggactacaggcgcccgccactacgcccagctaattttttgtatttttagtagagacggggtttcaccatgttagccagggtagtcttgatctcctgacctcatgatctgcccacctcagcgtcccaaagtgctgggattacaggcgtgagccactgggccctgctgagtctgggggtttttataggcacagaagggagaaagtgtgtgctgattggtccatgcgcagccatgggtaggcctggaaaaagcaccatcccattggccaaaaggcatcaaggaagttctcactcctagtctcagactccacccggtactggcagcccggcctccaggcttcaggccttcccttgcttgaaggtgaggtttcaccagggaccgtccctttcccgcctgggaatctgtctgccaggagcctcccttccatgcttgttggcatccaaagtttcagcctcagaagcagtttctggaggggactgaggtggcgggtggggtgggggcggggactggtgtgtcagcgccaccccaagtgcttgcacacccggcctagttgtgagcctgggcagggagaagccagggagcaggtgcaggcacttctgagcccacgggggcagggggtttcccgccctgcaagagcgcaaggatacccagtctggagctgctgctgggcggcacctgcactagggagtgcgggctcccactttgccaactcagtagggcgcaggactcctgctgggatcacctgttcctagcccctgccagctccaaggagtgtgcagctccagccacccccgccgcctgcccccccgccccccgctgcagctggcatcctcgcagtgaccactccacatgggccgccactgacatcatatgtatatttagttctatacaatgttgccatttttgtaggtttgtgtatctagcaccacagacaagatacagaacagttccatcaccaaaagcgtccctcttattactgctcttttagaaccatacccacctctttgccacccctccttcctaccccacatccaggaagaatgacattatgtgggcaaaaacaagagcagtccagaaatacacctcaaagtaaccactaatctgttttctatttctataattttgtcatttcaaaactgttatctcaatggaattatgtgatatataaccttttgggaatggcataatctccttgacattcatccaagttgttgcatgtagcaattataccaatttttcattactgagtagtatttttgtttaacattcacttgttgaaagacatagactgattccagtttttggctattatgaataaagctggtatgagcattcatataaaggttttaatgtgaccataaattaaaaggtaatattggctcatgagttgggaaacgttccctctttttctattttctagaagagattagcacgttatgtaaatctgggaccaggtgtggtggctcacgcctgtaatcccagcactttggggggccaaggtgggtggatcacctgaggtcaggagtttaagaccagcctgaccaacatggtgaaaccccgtctctactaaaaatacaaaaaattaaataagtaaataaatgaaaaattagccgggtgtggtggcaggcgcctgtaatcccagctacttaggaggctgaggcaggagaatcacttgaacctgggagatggaggttgcagtgggccgagatcacgccattgcactccagcctgggcaacaagagcaaaactccatctcaaaacaaacaaaaaactggtattaatttttgtttacatgtttggtaaaattatccagtgaaataggctaggcctggagatttcttttttcaaagcctttaaattacaaattcaatttttttttttttttttttttttttttgagacggagccttgctctgtcgcccaggctagagtgcagtggcgcgatctcagctcactgcaagctccgcctcccgggttcaagccattctcctgcctcagcctcccgaatagctgggactacaggcgcccgccaccacgcccggctaatttttttgtatttttcagtagagacgggatttcaccgtgttagccaggatgatctccatctcctgacctcgtgatctgcccacctcagcctctcaaagtgctgggattacaggtgtgagctactgcacccagcctacaaattcaatttttaaaatgtttataggactattcagattttcttcatcttggttgggtggtttttgaggaatggtccatttcttcaaaattattgaatttatgagtataaaattgttcataatattcctttattatcctttaaatgactgcaggatccgtcgtaatagaccctgtttcattcctgacattggtgatttgtattttctctatttttgtctctatttagtcttcctacatagaggttactaaattttgatgtttttaaaaaccttccaaagaaccagctttttgtttaattgattttttatttccaatatcattcattttgcttttatctttatttcctttcttacgcttttttgggtttatttagctcttctttttctagtttcttgaggtaataacttattgatttgaaacctcttcttgtttctactataaatttttaatgctataaattttcctgtcagcactgctttagctacattccacatattttgattttatattttcattttcattcaattctgtgtatttttaaatgttcctttgagacttcctgtttgtcatatggattatttgcaagtatgttgattaattttcatatgtttagagattatcctattgtctttctgtcattgacttttagttggattccattatggtcagagaacacaatctatgatttcaattttaaaacatttgctgaggtttgttttcaggcccaagatatggcctttcttgatggattttccattggtgcttaaaaaaaggtatattctgctgttgttgggtggggtgttctatttatgtcaattaaattgttagttaattttgctgttcaaaataaccttgctgattttccttctagtagttttatcagttgatgagtgcagcatgttgaagtccccatctataattgtggacttgtctgtgtctcctttcaaatctgtcaggttttgcttcgtgtattttgaggctctgttatttggtacatgcacatttagaattattatgttttcctagtagattgacccttttatcactgtgtaatattcttgtttgtctctaataattttctttgctctgaaatctactttagcagatgttgatttagctaattcagctttttaaaatgtttacatgatataattttttttatccttttacttttagcttacttaatgttgaatttggaccaagttcttgtagacagcctatagtttgttcatcttttttgtatgcatgctgccaattttagtcttttaatgagtatgtttagaccatttacatttaaggtaattattaatatgttagagcttaactctgcccttttattactctctctatatatatctgtatctatctatatatatatatatgatcatatatatgtctctctcccccctctctttatatatttgtgtatgtatacatatattacttgttacagacagtcaccctgtttaggtttagcatgaaatcctgccacattttgtgggctgtgatttcaatgatgtttaagtcccagagtctttgtgatgttattttgatctgtgaagtttatctgataccactggggctcccatggttccctcttggtactgccagaggaggcagaagggttttgcccaggctggaccacctctgggtgaaaagggagtctcaggcctttgaggccaaagatgcatctcaggagagacgcttttgaaggaatccctcttgccagtgccatctggccccctaacccagtctccctttgtgggacaagagaatctcagaccttgtgggagaaggagattgcttcccctggctgcttattagcaagcttcccagtcataaactctcttgcctttggcttgtcagctttacctggtgttgttgaaagtattcctgttcaatcctggggaggaatgagcctacctggactgccttctgtaccaaattgggggttgggtcatgctgagactggctgtctttcttctgtagagtagagggcacatatagtcctgaaatcccaaattagtttgctgtcctcttactaccgtaccttccaaagttttcttttggctgtctcttgcagtatttcttgggtttatagttgtatatacaggcgaagaacaagagaaatcagtctaagctagcttgtcaggactgaaagtctcaatcatgttttaaaatattttattaattttaatttgagggtaactttttccaacgctgcctttttttttgaggataactcaacaacaagaaatacatgtatataactatttttaaaatgaatcaaaattggctcactaaaattttgtttcttgaatgggtaaactttagttacttgaactttttcttaagtggaacatattaacaggaaagcaatagtcaaatgttgaggcattaaagtatatacaatgaatgtgttctgtgtgtgtgtgtgtccccattcctcatattctccattttttgtgctttctctgctctaatggcttttttcctcactctggcttgccttttcactctcttaatggtatcttttgatgaagagaagttcttaattttagtgtagttcaacttgttgttaaaaatgattaatactttctgaattctgcttagaaatatctggcaagcccaaggtaatgaagatactctttgttttcttctaacagctttattgctttgactttcacatttagatacacagtctatctggaattgggcatttttatttattatgtgagggctcaagattcattttttccccatatggatttttagttcattcagctctatttattgaaaagacatcctttgctcaccacatttgcagtattgcctttcttataaatcaggtctctatatgtggaactctttctggactcactataccagtggcaactggtccaactctttctgaaccactatagtgttcagtagaaatataatgcaagccgcaaatgtgagccatatgtgtaactttaaattttctaatgaccatatcttaaaaagtaaaaagaaatttatgaattttatttaataacatgttttattgagccctacctgtgaaaatattaacatgtaatcaataggaaattattaatgagatattttacatgttttggtactatgtctttgaaattgggcataaatttaacatgtgtggcacgtctcaagttagactctaaattttcaccagaaatacttgatctgtatttaggtttcatacaatcacagttgaataagtaggttcatatgcctaaatttgtccaaatcatacttcagagttttccagtaactgaatcacttatcagttcttgaatttaaattaattaaaaatttaaacattacaaattcagttccttaattacactagctacattttaggtgctcagcactcacatgtgtcttgtggctcttatattggacagtgcagctctattctattctattgtcagtctttactgtagaacatacttttgtaattactgtcactttatcataaatcagagtggtagtataagtcctccaactttgtttttggctattgcctcagctattgctaatcatttaaattttcatataaattttggaatcaccttgtcaatgtccactagcattttttcatcacagtttactactgtttacattgttagctgcatacgtgacaacaagaaatccaaagtgatattgagctattgttaccagtggagggtgcccaggctcttggcattttgaacaaagaattggacaaaatgcacaaagcaatggaagaatgaagcaacgaaagcatgtagttattgaaatgaaagtacactccacagggtgggagtgggctccaggaggtggctcaggagcccctgttacagaattttctggagtttaaataccctctagaggtttcccattggtaacttggtttacactctatgtaaatgaagtagtggcccacaatcagtctgattgcttgtgaaggtgaccaatcagaggctgaagtgaagttacatagttacaccctatgcaaacgtgtgattggttgcggaaagtgaccagtcagaggctgaagtgaagttacaaagctgtactcctatgcaaatgaagactgggcccgtgaccagtttggttgcaggaaaagaccagtcagaggtactttcatttttcatctgcaactgcagaaaaagtaggggtattacaaagggagtagcctctgatccctttgttacttggatgtggagaggtagggtgttccttttaattcagttctgggaagtcagcatgaattggccttaggttccctgcctccagaccctattctcctgcctcaccataaaggctggatagttgacttggttcttttcctaactaaacaactggttctgaaacagtggccttagtgtttcagaaacactaagtgaaacacttagtgaaacactgccattcctttatctgcacctctgcaaataagcttttccagataattctgaatatcagttattcaggccacaaatgcaaaccacagggtaggattttaacatataatatagaagtaaggggaaaaaaagtgaataaatacatttctttttttcttcttattttatcagagtggagtctatgaaggtgttaggaccagggaagaggttggagtagctgctgattttggaaattacatacagctctatcatttctagtacttagcacaaggcctggcacatactaggtattcaaatttttggcaaataaatggaagcattatacttaacagaactcattgatcagatatggagccattgttcttgtagttcatgagtgaggccctctattactgtaaactgagactttttggctgaaatgtctgagtaatattatacaaagtcatatatggcatttggctttgtgactttttttagaatatgaaaagaggtgtttggggacataattacaatagaattgctgtttaatttggtataactcatgatgcatgatatatgactggaaagtgagttgttctgatttaaatagaacactattgaagtaaatcatctcatgtttttaaaatagttctcaaattgtgttcgtactagatcagttatctggctgattgttctaatagaagtatctctacatttaaatgtctttgatttcttcatcaaccaaatgaactgacttactaaattcttgttctaaaggaattttcctgttggaatagactatcctaaagtaacttctacaacagttgttttaagctaggacatgttcaaaagcttcatatgacttatggcattaggttgaacagtcaagaaaacattaattggtttatttttctgataatatggctcactgaatcagttataaaacatttaaaacatatttgatttaaaaaggcatgacaacaaagggtcattttaaatgaatagataactacaaaaatgaatgagcaggagactagggaagctagcgagctttgaaaccactggataacctggggacatacacagacctagtaggtaacctggaaacttggagtaaaaaggggctggggcctgggcgatggagtgagacttcatctctacaaaaaaataaaaaagcattaacctggcatggtggtgtatgcctatagtgctagctactcaggagactgaagctggatcattgcttgagcccaagagttcgaagttacggtgagctatgttcatgccactgtgctacagcctgggtaacagatacttgccttcactatttctattttatattagacattaatatataacttatttgtaagttatttaaaatatatcttcagttggaaattgtagccagtgtaatgacacagggcagagagatgaaaggtataagagttggaaaggaagaaacaaagtggtattatttgtagatgatactattgtctatgtagaaaagtccaaggagtctacagaaaaatcaatagtttagcatagatgttggatataaggtaatgattaaaaataaatagtatttaagtaaacctaaaaccaaaatctattttaaaaaagacaatatttataatttcacaaaagtatatcaagatgtaagtgtgaacagacatgtaagatcttttcagagaaggtaataagattttattgagtgaaaattaaaaatcttaaatggagagaaaaaatattttcagatagggcgactgaatatcataattatgtcatttattcacaaaatgatttgtaaattcatgcaatttcatgcaaaaattcctgtggtttttaaaaatgaaatttggaaacttattttaaaatttgcagaggttaaattatcctggaaacttggagaagaacaagttagggagcaggcacttgatctacactatgtagtattatattactgatgtcaataatttataattttatggaatggtagcttcacagagatagataaatagactagtgaagcagaatataggcacagaagcagacctttatggaaacttaatgtatgtcagagtgacactgcaagtttgtggaaaaagaataaactgttcactatatattgctgggacaattggttatctacatgggaaataatgaagtggaatctctacttcccaccctatataaaaatccatttcaggcaaattaaaggcttaataaaaatagccaacacttatgttgtacatatcatattattgaccttgttctagcactttatatacatttactctttttatcatgttagttaccttcattttttaaaataaggaaactgaggcaagcacagagaagtcaagtaatttgcctagggtcacagtagcagagccacattttaaccaggtagtttggctccagtgtctatgcttttaaccactatgctatactttttcacttaaatgtgcggaacgaaactaaaattttcaatataagggcatttgtttatgaccgtaggatagggaagggttgtttttaaatttttgttattttttttttaaataattgggtctttatatgtttccgagacaggactgaaactccctgccttcaagtcattttcctaagtagctgggactataggctgtttctttttttaaaggaaggattttatgtttatcatgaaggaaaaaaataaatttggctaacttaaagagttatttatcaggagacactattaaaaaaaggcaaatcagaaatttggagaagatatttttaatactgataataagacagaattgtaccctgtaaccataaatatgtagaatttctaccatatcaataaggtataagtttctgttgctccacatcctcttgcacggttggtattttagacttttaaaattcttctgccaagcacggtgcctcatgcctgtaatcctagcattttgggaggccaaggcagatcacttgaggccaggagttcaagaccagcctagggaatatagtgagactccatttctacaaataataataataaataaacattattattgttattattctgatcctggtggtcatagaatggtatatgtatggttttaatttgcatcccttgatttttaatgagggtaagcataatttcctctattaatggccatttgtgatattttcttcagtgaagaacctgtgggagatggaacatgaggctgacagttggcattatgttgagcttgtgagaggtgatgtgattctaccttcaggtactactgggtctgtgcattctataaaaccagagaggcaactatgatcagatctcctgctctggctgattttttatttctaggagatttttcatttgtttgttttcatttagagctgtactcctgagtcattaaatagaacactataaatttgctggtgcaggtcataacatttgaagggattaacatttggtttattctctctaaatccatagctattaggaaataacctaaaacttcaggatttactttgcagaaatgatttccttctaatgtatgctctctcaaaggaatttagaatcctgttacataagaggctatacagctttaatcccattcattgatatttagtgaccagttaaacttcaaaacaatttttaaaaatttccctaatttaaaaagtaataataattatgtgaaaaaattttggaaaatacaaactcatagataataataaaccatttagagaactgtgacttaacacggtatattcttttgtcttttttttgtaacctttgcgtacgtagttgagaataacagccccattttaaaagaggagctttaaattcttattatgccccgttaaaaaccccacaggtaatcataattatttagaaatttaatcacacagatgttgagtcacaatttgtgatttaatttgattacttatgtattttcttatttttattcttatctctttcctggatgtgattttttaaaaagttgtggccactttaaagtcttttgagagatgaaatgggagcatgtgcctgttaccaattaattgcctctcagctccaaattcatccttcattgccctgatttgtgatattagagctgtaccctggtagctgtactatgctacccagaagataccagattatcttctgaccacaaatgcataaatgaacctagccaaaaccaaaagaaccacttgctgaatctagtacaaattgtcaacatgagctaaatggtgtttgctgtttgccactacatttgagggttgtgagttaatcattaaaagcacactgataggccaggcaaggtggctcatgcctgtaatctcaacactttgggaggctgaggtgggaggatggcttgagcccaggagtttcagatcagcctggacaacatagcgagaccttatttccaccaccaccaccacacacacacacaaaaagcgtactagttatactgctctattttcagtgcttagaacaacaccttttacttagtaagcattccctaaataatttgtgaataaaacaaatcaggtcagcccaaattcaagggatggaacaagaccattcagtttttacagctgctctctttattgagagaatctcctctgtcctctgtgcctctctatgttttataacacactgtattataacactggttaatgttgaattgtgattaaaaatttatctcctaagtaaggtgtttgaagacaaggatcagtttcttatttatcttttgctgttcaacaaatatttattgtatgcctactgtttcagtcactgtgctgaagtaaacagaacagataaggaaggttcttgcattcatgaaacttactgcaagtgcagtatttttaatcatactgctttttagcaagtttagtatcattctgctttttagcaaggccttgttttttcattttggccccaaaccattttttatccatgagccttttaatgttatattcttgcaaaatttttatctttagtcatcacttttgatttttatagttacatatttagttgttatgcaatatgtatgttttacataccaagtatgtttaagttaatatactattttccttagtagttaactcttttcttggttattcacttttgtcccccgttagcagtatgtcttacgtattttaagattcagagttgaaattctaaattccttttactcacgggaaattagattttagtgttttgcacaatgccaaatacatagtggacacttaataagcgttcgtttgtagtaatagcctctttggttttctatttcatagaatttcaccaaagatgattatttttgactgacttttaaatggctacatgaattcttgaccctcagcctaagtaaattttttcattgtggatcacaatacctactttctcttttccttcttcattttactcttaaaaatattaatgtgcaaatttggaagtgtcagtttcacaattgctaacctacttgaagtgttttgaaaaatgaaattaaggaaaatttagagaagtggtttattaccttaaaataattaatagcaagattcttcttaatatgttatgtcatagtcacatcatttatttatttactgattcattcttggttcagccagtcatccatttaataaatgtgtttcagtccttatcatatgtgcaaggtgctagtattatgaagaggaattcaacacagctgatatgtggagggatgtctttaatttatatttaaatctctgtgtgagatttgaaatattacaaaagactagagtataaatcaggtggaaaaagggacagcaaagaactgcaaggaacttaaccttttctagcatccagcttgaccattctataaaatatatttagcaaataatattctgatattttgatttgaaagcatgaggctgtagctctttcataaatgaaagatttttaaaggtacttatagcatctgcttattactctaaatctttgtgtcatatattgttgcagtgagtttgtgaggattgaattcagtatttagaaataatgattattgaaaaacatgaatacaaacatgtgcatcttaggaaagttatgtcagatgaattagttaatacctgaatagttcaaaatgatgaataattgttagaattataacatattataaattatcttaactacagatatagggatgttataatttgataattcagaacagggctgaataacaatcattctcccattaatttacaattaatctctctttacaattccagtgtgttttgtaagaaataattttccatgagtgaaataatgtaattgccttctctctctctctatatatatattttgtatatagatgaccagattaagacatgaaaacattagtgagataaaaaccaaagatttctctaatgggcagtttgtttgtaagaatgatggagatgatacagagtagctcatatatttacatgcctaagtgaattttattctgtgtttttatttaaatgtgaataataaatgaatccgtagatcagcaaggaggtttaaagtattcaaaaagcaaaagttaggacatttggggtttaatttttttcatttaattaaaatggaaaggatattatttaaccattgagctgggtaatgttaatagttcatggaggatgcaaaatgattcttttttctcttttggtgctcctttaatgaataaacatcatttttttttaatactgtcaaagcactttggagaatggaattgtagctgcacaacttatattaaagtgaagttactcttacaattctgttattctgttttctttttttccaaattttaaagacagtcttttttttttttttttttttgagacggagtctcactctgttgcccaggctggagtgcagtggcactgatctcggctcactgcaacctctgcctcccaggttcaggcaattctcctgcctccacctccagagtagctgggactacaggcgtgtgccaccacgtccagctaattttttgtatttttagtagagacagggtttcaccgtgttagccaggatggtctctatctcctgagcttgtgatccgcctgccttggcctcccaaagtgctgggattacaggcatgagccaccgcacccggcctggaaaatattttttatctccctttatttctttgattatctgccccactcccatgcttagcctagtttttacatacttttatttaatattaatattttataagttttaatatttattttcagtcttttctttccccttccccctccaaaacaggcttggaactaaactcatctttatctattaatgttaaatgagaatagtaaagttggaattagagcaagtacatgttatttttaaactgattactaattcagtaattcataactaattaaatgtctttatttttctagacccttactctcctccttttttctttcttgcccatctcattatcttataagtaatttgtgtttttaagtttttttctccctagataatagaaagggaaagaaggtagaacataaataaggattacttaataatttttcattcagttatttagctgtgtttcccactggcaaaaatatttctctactatctttgtatatattgaataatacattatttttaaactatatatatcagttactcttatcagtccaaaagcttatagaattaatgctcctcctccttttccttttccccttcctcctcgtcttcctccttctccttctttcttcttcctttcctcttcttcttcttcatttttctttcttcttccttctttcttcttcttccttcttctttcttcttttcttcttcttcttcttcttcttcttcttcttcttcttcttcttcttcttcttcttcctcttcttcttcttctccttctccttctccttctccttctccttctccttctccttctcctccttctccttctccttctccttctccttcttcttttcttttttgaatatatagagacagggatctctctatgttgcgcaggctggtctggaactcctgtgctcaagtgaccctctcacctgagcctcctgagtagctggaactacaggcatgagccactgtgcctggctctgcaagactgatgtagcaatctttttgtttgaggctggggtgacaaggttgttgctatgttgcccaggctggcctccaatttatgggcttaagcaacaagcccccttctcttatcactccccattactagctccaactgttcctatttacttatagtcctgaaatacagtagtccccctgtatcctgaggggatatgttccaagacccccattggatgcctgaaactgggcataatactgaattcgattgctggcaatcagaacacgtttctgttcacatcttctacccataaatttaatgccttttccatcttaactaagcacttatcacatactatggctgtaacttttgcagtttgaggtgctatattagtccattttgtgttgctataaacgaatacctgaggctgggtaatttataaaggaaagaggctttatttggttcacagttaggcaggctgtacagcaagcatggtaccagcacctgcttctggtgaggacctcaggaaactttcagttatggtggaaggcaaagggggagcaggtgtgttgcctggtgagagagagatcaagagttgccagcctctttaaggcaactagctcttacgtaaactaatacagtgagaattcacttgttactcatcacctcccactaggttccacctcccacattgagggtcacatttcaacatgaaatttggaggggacaaacatctaaactctatcaggtgcagtagcagaattagtacaaatatctttttccttcttcacaatctcacagatagaatattcattgttactgtaggtcttggcagcctcagcattcaatttctttttcccttgttaagttgagaacttttaccttttcacttaagaggaagtgctttatggcttccctttggcatatccaaattgccagcatcactattcttgagctttggggccattattaaataaaatgaggattacttgaacacaggcactgtgataccgtgacagtttatctgataagagagcaagctaataagtaactaatgagtgaggagcatatacagcatggacatgccagacaaagggataattcacatcctgggtgggatagagtggaacagcacgagattgctactctgagcagtgtgcaagttaaaatttatgcattatttctagaattttccatttaatatttttggaccaatattgacttcaggataacaaactggtaagcgaaatcatggataagcagggactactgtatttccagatttcttttccctctgtgcctttgcacatactgtttcctctactgagagcatatttctgctattgcccttccctttcttatcacctggcaagctctttttagcctgctcagaggttatttcctgaagccagtttattacacttcctccttttctgtattcctcctatagcatctgatgtatgcctttaagatgactatactgtagtgttttatcacctcccttgactttgagctccgtgagaacataaatggattatttcacctctcttcatgatttggacagaacactcaattgttagactggaaaggagaaaggaaactaaagtttgagtgtctcttatgtgccagggaatgtgcttaattgtgttgttttagacacaatggaataaattcaattgccacaataaattttgtaagaacatactatcataattagtatatatttttattacatattatctccatcttatagttcagaaaactgaaattaattaatttccccagttattaaatactagagccaggactcgaaccaaggcctgttttgactctacggtctccggttatttcattttactgtgctgtttctttactactagtgtaattgatgatatgatcttgtgtaatgtaaagaacatggacttggacatcatacagacctggatttgagttctagtttaccatttaactaatgttgacaagtgtcttaatcgctataaatctctgtttcccccctttaaaaaatgtggttgttatcattatttactttagaggattattgtgagaattaaatgaaataatgtattagagggttttgtgcagtgctgggcacatgatagatgctttataagatgctagttgtatcttatctgatcaacagataagttgatcaacaggtagttgatcttatcatagctacaagcaacagaaaaacttacagtggcttacagtggcttagcaaaaaaacttttaaatggcttcacataataaaaagtttggagatagtcttcaatgacttaagtttctttctttctttctcatagtcttaggatatctgtgaagttgcaggtgttacatttaaagcagaaaaaggaatggtatcatctgtgtctatatcttttattagaagagaaaaaaccctttccagatgtttcctttgtatctcactggctggaattggttacatggactactgtaatagcttagctgctctcctaactccagtcttgccattatctaagctgtgaaaaacactggaaaagtggagaacaagttgattgtgattagatcaacaattattcttctactagggatgagcacattgctccctcatataaagttacagaagtgtcttgtacagttctggtggtggtggtgatgatgatgctatgtgatgacatagcactgaaaaccattgcaaggtatgcttatcatttcattagtctgaagcagttaataagtaagcattgtgcattgttttaatccatatcacataaagactaagagtagctcagctatgtccttatatttaagtgctaacattttacaaaattggctttacaggcattttcttatctcattagcttaagaatgcttaaaaaaatgctgcttctgttacttctgattgttcctaccctcctgacacacacatcaaacaacaaaaccaagtggacaaccgccactaccagatatataacaaagaaaccccttaacattgctggagtccctctgatagttttttgtctcctgctctttttggagatctatagcttcaatgtcaacttccggaagatgatagtattcttaaggccactttttctacccctaatatctcatgttgggatttcccctttcactcttaccagactcagtgaaaacaaagggatctgctatagttctgccttctacccctcagcttcctattattggagccttccacaattattagatctccttctgccttctcaccctgttgattttgggctgactgggagagaagaggaaaactgaactgtgaagctcttgctgcgttgccagtgattgggaggatatgttacccaatgctcgcttgggttctgggatgaattttgccatagaaactggtataatggatgtttgggttgtgtactattattgcttctctagttcaactacattttggcttttgaggactggcctgagatctataaaataccactatatatgattcctttagggaaatactttgactgccaaccaatttgaaaacaaacattcagagtagaatatattaaatcatgagttgaatgacctatgtttgggtttttaccattctgtaccttgataggatgctagagtaatacacactcatccccagtaaaaaggcagaagctaaggacatggataattagttgcctgattagtccctctataataaaaaagttaagaacatggaagattcgtcttggttgcagaatgaagtatgttctttcctatgagtacttcatatgtattaattttctttttaatatttacatgttgaagcagttatttttccattaggtctttactcagagagcttagagatctatatgtgtagagaattaacatctgattattgcatgatttcattctttggcttaactaaattgttttacaaatcgaataattgtttacttttgtattttaaaaattttcttccagtgttttctcaagcaaatcaatgttaatgccagattttctagatccttagatttactagatggtttttagtcattcagaagccacttataatttagtagagtaataaacataataatgattatcaggttcagcttccaaatatttgagagagagcatatatatactttactgtgacaacttttagaaactgttttgagatagatgaagaaaaggcagaagatatgttgagaagcagatgttgtatgacggaagtacccagctgtgcactaacaaaatgaatctcatgccgattagttaacaattctttggcagtcagagacatatgtaaagcagtgaacacagcatggggaaataaaaaaaaattaaaagcattttctaagcctaaaacattggcagtatctagtctaccatatgtgttactgaagaattggttttattgtggataagtcataccaaggtcacttgcaaaaaaaattggttaacccattagagtcttcattctcaaaaatatatatgtgtatatatatatgatcattatgtatttcatatatatataacgtacaggcatattatatgtcatgtatacaatgatcgtatatataatgatcatagcagtgagtttatatatgtattatatatcatacatatatatatataaaactcctgggctcaagggatcctcccacctcagcctctcgagttgctgggattacaagctactgtaactggctccatagccttagtttagattcttcatcatccttatcttgactattatgttagcctcacagctgctagttttgtctgatacagtagatagtttagattgtttaatgatttcttcataacatatatgttaaagtataagatcctcaaaatttataatttgccctcagtttatattagctgggcatttccatcttgtattatattgtaaattctttgagtggagcctaacatctttttattcatcactatgttgtggacatagtaactactcagctaatagttgttgacttaatgagatagacctaggcagattcttggcttagcaattcagtatgccttgctcaaattaaaacgaattattctgttagtaggaataataacattattttaatatattaataattcacacataattttacagtagtaatttatacagcccgctggttctgttaatttgaattagtaagatgttaagctattatgtgcaatggttctgagttccagtagttctgattagagttgaaaatttttaatgcacagaatatagtaatgtctaccttcttgaagactagcaggaagctttgttttggttagaattactttctttttcctagaagggaattaatggaattgagtaataacaagagcatacactaggttttggatatttattgtggtacagagtaaaaattagcagacgactcctcattagaagttttactcttgatcagaagtttataaagcttattttaaaagtttataatctttaccttgtataaataagtctttaaccaagatcatttatgatgcttagaatgtaccaatgattcgttacttaccctaatggaatattgtgagtaactggtacaatcccatccgtagtttttgttttagtttgcaacttttctttttaaagtcccttttaacctaaagtttgattaatacattgaaatgtgataaaaattgttggttacctgttgtgacattgtttttaagaaaagtgtttatatcatgaaaacaagtttcttacagacagactatatgttttatatatttattcattttgtaaaaattgaggtataatttacatatggtaaaatttacccttttatagtatgcatttcagtggtttttagtgtattcacaaagttatgcaactatcagaagaggattttggtaagacggagtgggaagcatcagaaggtcttacctcacctagacaacaactgcactggcagaatctgtctgatataactattttggatctctggagtctactgaaggctttcactttccagggagaagatttggatctaattgtggttatttttggtcagttacagctcttcgcatggtagcagctacccatccactaccccagccccatggcaggcagttgtgccaacaggtgttccagaaacagttttcacacagctcatgggagctagagtgggcaaaaagcaccttgtcctccaaatattggggatctgtgctctgattgctatttctgctcacagaggtgcagagagaggatggcagcctttgttgtatacctacccccattgttgcagtcccctcccccttcagctgaagtgattccaggggatttaaagggttagcacctttacctcctcatttttctctttttgggagcagacatgaaaggctagaatattcaaaaacaatggcatatgtgaggaaaaattagaaagtgactgtgcatgcccagggaaaggcacaggtttggaaaagacctgggaaaaccttaagtttacatttcaggctgatcattggcacaaagacaataccaatcaagacaaaaacaataaatagaaataacaacaaaacccagcaaaccctgaggaaagaggagaatctgatttccagagtaaccatattattagattctagttttcaacataaaaatgacaaggcatacaaagaaacagaaaagtatggctcattccaaggaaaaaactgaatcaacagaaactcttcctgaaaaagacctcatgtcaaatctacttgacaaagactttgaacaactgtcttaaagatgcttagggaactaaaggaagacgtggggaaagtcaagaacataatgtatgaacaaagtggaaatctcaataaacagaaaacctaaaaagaaaccaaaaagaaattctggagctagaaaatacaataattaaaatgaaaaatccattagcagaatttaaaggcatatttgagcaggcagaagaatgaatcagcaaacttgaagagagaataatggaaattattgagtctgaggaacagaaagaaaaaatactgaagaaaaataaacagagcttaaggaatctgtgtgacactaccaagtggaccaacataaacattgttggagtcccagaaggagaagagggagagaaaggggaagagggaatatttgaaggcttaatgctgaaaacttttcaaagctggtgaaatacatgaatataaacatccaaaaagttcaatgaactccaagtagtgtgaacccaaagagacccacaccaaggcacataatcatactttgacagccaggtgtggtggtttgtgcctacagtcccagctactcaggaggctgaggtgagaggatcatttgaggccaggaattcaaggtcagcctgggcaacatagtgagaacccacctctctaaaaaataataataaaaaaaatgagtcaggtgtgttggcatgcacctgtagtcccagttactcaggatacttgggaggctgagatgagagattgcttgagcctaggagtttgctgtgattatgccaccacactccagcctaggcaacagagcaagaccctatctcttaaaaaatcatatttttgaatgacagagaatcttgaaagcagtgagagaagcaacttatcacataccagggatccttaatattattattggcagatttctcatcagaaactttggaggccaaaaggctgtcggctggcatattcaaagtactaaaagaaataaactatcagccaataattctatgtctggcaaaactgtcctaccaaagtgagggataaattaagacattctcagataaacaaaagatgagggatttcattaccactggatctgtcctgcaagaagtgcttaagggagtactgcagagtgtaatgaaagaagactagacagtaactcacagctgtatgaaaaaataaagatctcaataaaggtatatacatgggtaattatgaaagcaagtattattgtaacaacagtttgtaaccccactttttttgttttcttcatgatttaagagtaatacattaagaaaaacaatcattagtccaaaagctagtattattgtcactttggtttgtaactccacattttttttctacataatttaagaaactatcacatttaaaataattattagtttttgtttttggccacacagtgtctaaagatataattttgtgacatcaacagccaaaaggggaggaaatggagctgttatgggagcagagttttagtatgttgttgaagttaagctggtaataatttaaattagaatgttttaactttagcatgttaaatgtaatccccatagtaaccacaaagaaaatagctatagaatatacacaaaaggaaataaggaaggaatttaaacattttactacaacaaagtcagtgaaatacaaagaaggcagtaatgcaggaaatgatggacaaaaatgtataaagcatatagaaaacaaatagcaaaatgacagaagtatatatcaataaatgctttaaacttaaatgcgttaaactcttcaaccaaaagacagagattggcagaatggattagaaaaacatgattcacttatatcctgtctacaggaggctcactttagatccagagacacaaatagattgaaagtgaaaggattgaaaaagatactccatgcaatagtaaccaaaagagagcaagagtggctatactgttatcagacaaaataggctttaaatcaaaatgttgtaagagacaaagaaggacattatatattaataaatggttcaatacagcaagaggacacaacaattaaaatctgacatatgccacaacatggatgaatcttcagaacattatgctgagataagtctgtcacagaaagacaaatactatatggttctacttatgcagtatagagtgtagtcaaaaatcatagagacaggaagtagtatggtggttgccaggggtgcagtggaggatagaatgcggaattagtatttaatgggtaaacagtttcattttggtgtaataaaaatgttttgaatagtgatgatggttgcatgatggtgtgaatgtatttagtactactgaactgtacacttaaaaatgattaatatgttaactttatgttatgtgtattttacaactatgacagtctattttgtgctgctgtaacagaaaacctgagattaggtcatttataatgaatggaaatatatttctcacagttttagaactgggaagtccaagtcagggactggcatctggcaagggccttcttgctgcattgtcccatggcaaaagggcaaagagaggtcaagggaaaggaaaggggatcaaattcattttttatgagaaacctacttctgagacagtagcattaaatcattcataagggcacagccctcatgggctaatcacctcttaaaggtatcacctcttaatacaattacaatgggaattaaacttcaacgtaactttgggaggggataaatattaaaaacatagcaatcacaataaaactgggaaattaaaaaaaaattgtgcggctgggagcggtggctcacgcctataatcccagcactttgggaggctgaggcaggtggatcacctgaggtcaggagttggagaccaacctggccaaaattgtgaaatcctgtctctactaaaaatacaaaaattagccatgcatggtggcatgtgcctgtaattccagctacttgggaggcagagacaggaaaattgcttgaatctgggaggcggacgttgcagtagagccgagatcacgccactgcactccagcctgggtgacagaacaagactgtgtctcaaaaaaaaaaaattgtgcaactatcatcaatatataattccagaacatttttatcaccccaaaggaaacccatattcattagcagttacttttctgcttagcccctggcaaccactaaatgactaaaaataaaagctgaagctatgataggaatgtcttattctaattttggtaatattcattatattttaagtagacagatgtaaataatgggcaaataatgcttttaattattttctttaacccgtcttagagccaagaagcttctttcaaggcagtggtacatggtggaggctatcagagtttctagaataattatctaggctgaaagtcatatctgggctttttggtgatctttctatgtgagcacgtacagctaatttgactaattctcttcaaatatttcttgaagatgtatgttacaacaaggcttaggttataatattagaataggccttctcttttgagtggagtaatatgattattctaataaagatcctttcttcactgaggctactgtttgggagttgaagtaactgggaaatttgaacctacccttctcctttcacattatatcaccagtataagagcagaattgtcagatattccgttaaatattggatacgaaatgttttttaattgataaataatttgtgtgtggcagtatttctgcattcttgtcctataaactaatatcagagttctttggttgctgtgacatgcctcctcagattaatagtgagatttcttcctgtaggtaaccctaatttcttttaaagcaatgatttatggtattatgatctaaatgccttttttttttaagagatgggatctcaccatgttgcccaggctgagctcaagctatcctcccacctcaccttggcttcccaaagtgctgggattacaggcatgagccaccatacccggccctcgatgcatttttaatgttacattagttgctaaaaaataaaacataaaaaagaggccgggcacagtggatcacgcctgtaattccagcactttgagaggcgaggtgggcagatcacctgaggtcgggagttcaagagcagcctgaccaacatagagaaaccccatctctactaaaaatacaaaattagcccagcgtggtggtgcatgcctgtaatcccagctacctgagaggctgaggcagggaaattgcttgaacctgggaggcagaggttgtggtgagccgagatcacgctattgcactcccctgggcaacaagagcaaaacttcatttcaaaaaaaaaaaaaaaagaatattttgcaatatcagggggcaataatgtgatatgctggatagtaaaaagttaatgaggacatagatgcctagtctaagcaaaatagataagaagttgctgatcgtaattgatgagaatgacgtcacagtggaatagcagataatgcatgagtggtgaatttcctcgtttagtcttactttgaggcagcaaataaatcctttataagtgttgcattacttttatggtgtgtgtgtgtgtgtgtgtgtgtgtgtgacagagagagaggcttcaatccttaaatcatgtaatattaagaaaaaacaaatgaattcacttagaagatttggggctggatctatattttttcatcattttaacatttgggggttaaaatttccagaccgttggagacgacatccatccagaacagagtagatcctggagattctggataaattatctgcaagtgcatttttttttcccaatagattgagtttattatcaacattcagtttgctgattaaaaaatttttcagtatatcgatattgaactcgagttggaagaggcgagtctggtctcaaaatggagggccatgatccaaaggaaccagagaagttgagaaaactgtttattggtggtctgagctttgaaactacagatgatagtttaagagaacattttgagaaatggggcacactcacagattgtgtggtaatgagagacccccaaacaaaacgttccaggggctttggttttgtgacttattcttgtgttgaagaggtggatgcagcaatgtgtgcttgaccacacaaggttgatgggcgtgtagtggaaccaaagacagctgtttctagagaggattctgtaaagcctggtgcccatctaacagtgaagaaaatttttgttggtggtattaaagaagatacagaagaatataatttgagagacttctttgaaaagtatggcaaaattgaaaccatagaagttacggaagacaggcagagtgggaaaaagaggatttgcttttgtaacttttgatgagcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggaggaaactttggaggtggtggaggagctatggtggtggaggtggtggcagcagaggtagttatggaggaggtgatggtggatataatggatttggaggtgatggtggcaactatggtgtggtcctggttatagtagtagagggggctatggtggtggtggaccaggatatggaaaccaaggtggtggatatggtggaggtggtggaggatatgatggttacaatgaaggaggaaattttggcggtggtaactatggtggtggtgggaactataatgattttggaaattatagtggacaacagcaatcaaattatggacccgtgaaaggggacagttctggtggaagaagctcgggcagtccctatggtggtggttatggatctggtggtggaagtggtggatatggtagcagaaggttcgaaaaacagcagaaaagggctacagttcttagtaggagagagagcgaggagttgtcaggaaaactgcagcttactttgagacagtcctcccaaatgcattagaggaactgtaaaaatctgccacagaaggaacgatgatccatagtcagaaaagttattgcagcttaaacaggaaacccttcttgttcaggactgtcatagccacagtttgcaaaaagtgcagttattgattaatgcaatgtagtgtcaattagatgtacattcctgaggtcttttatctgttgtagctttgtctttttctttttcttttcattacatcaagtatattgccctgtaaattgtggtagtggtaccaggaatgaaaaataaaggaatttttaacttttcaaaagaaaaatttttcagtatatctgcataaatgaaattggtccatcatgtgtattagaggaagctatccttactccgtttgttatcaggattatgttagcttgaagaatggactgataaactttctataaggcttattacaggctttaacctgtaaaattgatctcatcgtaaacagctttgagagtatacagatagttgactatttttcttctctggtttcttcagatactcttcatcatcttggatttgttttaataatttatatatgttaaagaaaataatcaaaactgtgcagatttataaatctttaaaattgtacacaatattatatattttaaaactccctacatatgcagttttatcacccttctcatttatggtacaccataagactcactttttgatgccaagtgttctcgaaaatgtcctaaggaagatcattgctggaacaatgttatttttgagacttttgttccttataaggaaatagacatcaattaaggagggaattttttttttggaggtggaaatgggtagtatgatcaagcaactatatgtatatttccctggggaacacggcattaagaagagaaaataatcccaactattaacaatttcatctgtgcagtggtttttattctgcaacattgtcttttctatttttgtacatgttttctagaaaaggtaaacatgtagtagaaataaatgtgatgttaattgctatggcagtgtgtctgtacacattacttttttctcctgtctacccaccttccattggcaatcacccaactggttaggtaaatgagggtggatggataataaacgtttcttcacaattacttccttagctctcaaaagggattctgaagcattccattataagtgctgcttacagacatgctgaaatgaccactttttgctctggagtgatattctttgcttaataaagaacaagagatcacaatatctttctttcctgagcagaagcagggcaaactgttgattcctttttgtttttttcctgcaaagaaaggaccttgcttatgtcacccaatttcccctttcaggaaggggaagtaatttttagtaagtcaaggtatgtagtagccataaggtcttctgtttaggattaaggttcagtgaagtcatttggcattcatttatttttggagttttgatccgaaagctgcttcattgcagaattttagtctgaattatgttctaaagattgatgatctctctatgggacttcactgtaactactccattaggacatcagatttagccaagtatttatgtgttaattttgttggattaacttatgtgcatagacatacacacacacacacacacacacacacacacacactgaagcctcattgttcccttaaattttaatttttatttgatatcttttcataatctattgagaaaagttatgatgggaatgcagtactgtgagtttgcactgacaataaaggttgatctatgacagcctcttagaagcaactactttaaaatattttatagtgggaaaaaaccccacaaatgcagttgttgttttgtatacttttttctctgttgacctgaataggattaaataacctctagggtgatttgcccattcagcaaagtggcacaggccaaaaaggagattaaagtaggatgagggggaaacaaggaaaacatgacaaaggaaaacccaagattagaaagactcagtgaagaaattttactcaaagaaataaagaggttttttcttccttcagtatccccaaagcaatatagcaggaaatcttactttgattatccatcaacaagcaagagtggaattaataagttgaccagcaaattgatacattccactgtgcacgcaaaagtcagacccttataagtaagcagttgcatgatatactttataagtatataagcacatatgttacaagttcttcatgggaaagcagaccagctcagcctagcctgaatgccacctagtgttctcttgtatgtataggatacaagtggagccaatggttgattaattgaaaatgacaattaagatagggaattacataaattgatataaattttcatgagcatttgatttttaacttaaagcatatactgactggagactgctgtcatctttcttgcataaacaacatataatgcttgtctcctgtttccaattcaaatttccataaagtagaacaagagcttagcaaactgagtatggaatcctactcgatttttatattttttataacaatttttcttttctaacattttgagatttacctttccaaagctttcagtgttttcccaaaacatttatctgttttcatagaaacaccctttttgtactcatatttcataatatttaattaaatattaaattgcataatcacaaattggcataaaagcagtgagaatgaacataacttggtaaaacagaatgtgaagacatactgctattggagtagtctgtttgatttagcttgcctgtgggcagctgcatgttttaaacaggaaatgtagagctagcccttacatagtggagatagcccatttggggagtttctgctctgtttgatttggctgatgcctgtattcttctttagggataattagctatgataggcctttatggctaagactttaaacaataatacttggtgaagtgagttgtcaaggagctaaatatacacattagtatgagaagagagcaacacgcaatctgatttcagagctggtgcacttaaccatcatgctatctactgcttccccttgtgggaagtattagcatgccactttatgtccataatatagcaagtagataagaaatggtgcataggaaataatataattatgctgacccttttctatattaaacattattctcaaaaaacagagcatatacctcagatatctctagaagagttaccaaaactgatcttctattaggttaacagtatgccactaaatgagtaagaacaggaattatgcaagccatttatgtagatgaaattcaaatagaattataaataacaaaactgaaaaagccatttggttgataattattatttgggatgcatattttgcttgttttaaattagttttcagggtcttcttcctttaggggtagcttagctcagtctttagcctgattcagttcaagagaagaaaggctaactactttttacccataagaggcagtgcagcttactctctggagtcaagctaacaagtatgacctgtccgtacattttaatttcacttagtagctgtgtgacctcgggcaaattaccttacctctcttgtctcagttacctcattataaaatagggattagtatctattacacagaatttcttttatttatttattttattatactttaagttctgggatacatgtgcagaatgtgcaggtttgttacataggtatatacatgtcatggtggtttgctgcacccatcaacccatctctacattaggtatttctcctaatgctatccctcccctagccccccatccctcgacaggccccggtgtatgatgttcccctccctgtctctatgtgttctcattgttcaactcccacttatgagtgagaacatgcggtatttggttttctgttcttgtattacacagaatttcaatgagaattaaatggattcatgtgaagttcttacaacagtgcctggtgtatagtaaatgctcagtaaatgatagtcatcatcatccttatcaaccttgaaaaagggaaatagtgatattattgttgaaaatatagccagaaacatgaatctgaagtatgtagtattggagattaggtacagaataaacaagaagtagaaccagagaaggcatacgtgaaaaattaatgtgtggtccagaatagatgtcatagttctgggcattacctcttgttcattaaaagataaatagtgggtcagggtagaaataaaaaaataagctggaggaaggaaataataaaaatgacatagaaatacagtaggataaattcgagagtggactttctgaaaaatcccaataatatatgagtacctacagcaaatctaattggaaaagaaaaagaacgggggaaatcatttaaaaagttaaaaagaggatcagggagagatcctaaatagtgtgagagactgctatgcagagttgtgtggtaatatatttggaaatcttgatgaaatctaaaatttcctagcagatataaaaatcagctagagaaatagaagactgtgattatgtcattcttctgcttgaaattcccctaaatagcttcccattgttctcaagataaagatagatactttcaacttgtcttccagtcctccctgatctgacctgtttcttgccatccaggccttgcattcttttcccttgggctcctgcactctggccatattgatcttctttctgttcatctaatactgttctcttttgcaccaggacctttgcacgtcctgtttgttttgtgtgttttgaacacttaatttctattaatccttagatttctactcaagtttcatgtcatggggaaactgaaccttactcttcacagactaggtttgggtccctgtgccatctgctctcatagctccttatactttgttttcatacttaacactattaacaattatttctgggtatttatgtctctttctccccaagtatatcataatttctttgatggtagaattgatggctgttttgcttattcttgcctagcacagagagaggtactcagtattttctgattaaataaggacttgcatagtcaaataacctcttccgttttttcttttttctctctcttttttttttggagatggagtcttgctctgtcgcccaggctggagtgcagtggcatgatctcggctcattgcaagctctgcctcccgggttcacgccattctcctgcctcagcctcccgagtagctgggactacaggcgcccgccaccacgcccggctaatttttttttttttttttttttgtatttttagtagagacaggatttcaccatgttaaccaggatgttcttgatctcctgacctcgtgatccgcccacctcagcctcccaaagtgctgggattacaggcgtgagccaccacgcccggccccattttttctttaatagtgagatttagaaacccatcctctctctctctccctctcaaacataaaaaacaacctaagttgtttcacagacacattcttgtaagctttctaggaaataattttctatatccaactgttttgtaacatacccatatacatatagaaagctatccagttcattttatttcaatctcaaatttgataaagtaccaaaaagtagtaatacagacctagttcagtcatgaatatggatgggaaaagtcaatataaaattctagcaaatcagattcagcaggatattaaaagaacatttcataacataagttatacattgaatttaaaaagtaggtgaatattagattaaaaatgaaaaaccacatggtgatcttaatgccacaaaagagtttgataaaactcaatattcattctttataaaagtatttaatggtttggatgaagacttcttcagttaaagaaaaacaaagaagaatttctgtccaaaccaatatcccagtatcttgctatataatgaaatgatagagtcatttctatgaaaataggataaaataaagaggcttgcggatacagccttttttttttttttccaagttctagacaatgcaataaaacataacagaaattagaagcagggcttttggaaaaaaggagatacagttcccatttatttgcaggccgattggttatatctagaaaccaaagagaaaattaaaaacttttggaattagtaagaataggtatgaattaatatgagagttgagttggatacacatgtttttgagctgattcatgcaaaggctttccaagctcctttgtgttttactaggttgtgtttgcttaaagttggctcgctagtacgcagtcatgagtcaggggaagagaaggagcctgactggctcctatattgttctgagtcatatttctttttttcagtggaattaaaccaacatgattgttgaaagagatcaaaatttggcaggttttcatttgcttgatatctgtaaacagacttttctttcaggaaaggaatttggaggagggcagagccatcattatctcttttttacaaatctacaatttcccatttgacccttacaattaatctgaaagtcaatttgtgtttgagattatacgacagtaacaggttgataagcagacatttctatgtcttattcgataagaaatactgaattaagttggagaatggaggtcatgtgctgccccgtacatttctcatcttgtcctcagcaaggactatatggtaattttcatagattttgtcaattaaatgaccgatatttgagtaccttttaagtgctagttcctgttcttggtggtaggattgcagtggtgaagaagatatattctgttcttaagaggattacattgcagaggggatagatagataataagctgtgtataaataagataaatttaattataaataatactgataaatatagagaagataaaataggtattgaccaattatgaatggcatactgtatggcaagagctttttagatggagtcaaagaagtctttgctgaaaaggtgacatttgaattgagtcatgaaggatgaggaagaggaagccatgagggcacctgttctaagagcatttcccagcataaagaactatgtggtgacaataaattcagggacagaaaggaggccaatgtggctgaagaacagtgaactaagtgggagagtaagaagaggtaatgctggagaagtagccaaaaaccaggtcacgtaggaacttgtgggccataagaaggagtttggatttttggaaatgtgttggaaaacctttagattgtttgtttgtttttcaaagtgagatgtttatgatctgtgtggaagacagacaagaagaaaacaaaagtggaagtagaaagaccaggtaggacatcgttgcttgtgctggtggcttgggtccaggtgggtgcaatggagattcagggcagcaagtagaatttgactgatggattggagtggtatgaaagaaagagtcaaggatggccctaattttttgatctgaataataaagtgtataatgaatgctgtttgctgaaatgggcaactcttgagattggaagtgaagctatgagttgagagcactttctctgttttggctgtgttaactctcagtatcccccggaagtcattattatcatttgccatctgaatccattataccctgtttactttcaatttttatgttttttacttttatatttttttggagacagtatctcactctgttgcccagactggaatgcagtggcatgatcatagctccctgcagccttgaactcttgggctcaagtaatccttccaccccaggctcccaggtagcagctaggactacaagagtgtgccactgcacccagctagttttaaatttttttattgttttgtggatacgaggtcttactatgttgcctaggctggaatgcagtggcacaattatagctcactgcagccttgaactcctgggctcaagtgaacttcctgccttggcctcccaaagtgcagatattacaggtgtgagccactgtgcctgttcattttctaagttattttataaataattaacacaagtaaacaatgaaaaacaaccttattagaaactttaataagaatttaaccatagcaaacccaattttttttatcctgtaagttcctggttttgaagacacatacatattcaaaatgagaaaaagtcctttgaatataatcatcaattgctatatacaaacctgtaacatatacattatataaatactgatttccagatttaaaatgaatctcttaatatgttctgggtttatcattacttctggtttttgcattttattgtcaaaaggcagtatttttgaaaactttgatggctaagattttgttgaagaaaggataaacactttcaattgaaaagtatttttgttttttagatttatcaactaatgagaatgatcgatttaatgaaatttgttatttctacatcagttattttttctccacactttttatatagatacttatcatcagcatttgtctacctatgaacttcatcaagtaaatttagcttcataaacatcataaaaagatcaatgaatactaccacatattcttttaactaaatgggatggtctaggatcttgtaacatattgcacaatgaagtttcctgttgaatgactgtctggctaaaagtacttcttgtccttaaaaatcatattgtacattcattccttcttaagtttcagaaaatttatctaggatatcatcatctgaagattcataacctgagatttcactactacctgcctctttacattcaccatctaataactgtgaaatatctttctttgtcagttttcttctctttgccattatgggtagaaaatgaaatattctgaattttcaaccgtgtttactgaaaccctcaaaaatacaaagataggatttccagccttcttttcaaaagatgagacaataccaccaaccaaaaaaagcctgggacctgatggattcacagccagattctaccagatgtacaaacaagagctggcaccattcctacagaaactattccaaaaaactgaagagaaaggactcctccacaacttattctatgaggccagcatcatcttgataccaaaacctggcagagacacaacagagaaagaaaacttcaggccagtatccttgatgaacattgatgtacaaatcctcaacagaatacttgcaaactgaatccaacagcacataaaaaaggtaatccaccatgatcaagtaggcttcatccctgggatgcaagattggttcaacatacacaaatcagtaattgtgattcatcacataaacagaactaaagaccaaaaactacatgattatctcaatagatgcagaaaagacttttaataaaattcaacatcccttaatgtaaaaaactctcaataaactaggtattgaaggaacatacctcaaaataataagagccatctatgacaaacccacagccaacattgaactgaatgggcaaaagctggaaacattacccttgaaaaccggcatgagacaaggatgtcctgtcttaccacttcaattcaacatagtactggaagtccttaccagagcagtcatgcaagagagagaaataaagggcacccatacaggaagagaggaagtcttctctgtttgcagatgacatgattgtatatctagaaaacccaatagtctcagccgggcacggtggctcacgcctgtaatcccagcactttgggaggccgaggtgggcggatcatgaagtcaggagatcaagaccatcctggctaacatggtgaaaccccatctctactaaaaatacaaaaaattagccgggcgtggtggtgggtgcctatagtcccagctacttgggaagctgaggcaggagaatggcatgaatccaggaggcggagcttgcagtgaactgagattgcgccactgcactcaagcctgggtgacagagcgagactccatctcaaagaaaaaaaaaaaagaaaaccccataggctcagcttgaaaactcctccagctgatacacagcttcagcaaagttgcaggatacaaaatcaatgtacaaaaatttactagcattcctatacaccaacaacagccaaactgagagccaaatcagaaaggcaatcgaattcccagttgccacaaaaagaataaaatacctgggactacagctagccagggaggtgaaagatctctacaatgaaaattacaaaacactcctcaaataaatcagagaagacataaacaaatggaaaagcattccatgctcatggataggaagaccccatatcattaaaatggctatattgcctaaagcaatgtacagattcaatgctatttctatcaaactaccaacagcattattcacagaactagaaaaaactagtttaaaacccttacggaaccaaaaaagagcctgaatagccaagggaatcctaagcaaaaagaacaagtgccagaggcatcatgttacccaacttccaactatactacaaggttacagtcaccagaacagcatggtacaggtacaaaaacaggcacatagaccaatggaacagaagagagagcctagaaatcaggccacgcatctgatcatcaacaatgctgacaaaaacaagcaatggggaaaagactccctattcaataaatggtgctgggataactggctagccatatgcagaagattgaagctggatcccttccttgcaccatatataaaaatcaactcaagatggatcaaaggcttaaatgtaaaattcaaaactataaaaaccctggaagacaaccaaggcaataccatcctggacatagaaccggcaaagattttatgacaaagacaccaaaagcaatcacaacaaaagcaaaaattgacaagtgagatctaattaaacttaagagcttctgcatagcaaaagaaactatcaacagaataaacagccaatctacagaatgggagaaaatatttacaaactatgcatctgacaaaggtctaatattcagcatctataaagaacttaagtaaatttaggggagaaaaccccatttaaaaagtgggcaaaggacatgaacagacacttcccaaaagaagacatacatgaggccaacaagcatatgaaaaaaatcttaatatcactgatcattagagaaatgcaaattaaaatcacagtgagataccatctcataccagtcagaatggttatcattagtcaaaaaataacatgctggtgagattgcagagaaaaggaaacacttatacactgttggtgggagtgtaagttagttcaagcattgtggaaagctgtatgatgattcctcagagacctaaaagcagaactgccatttgacccagcaatcccattactgggtatatacccagaccaatataaatcattctactgtaaagacacatccatgtgaatgtttattgcagcactattcacaatagcaaagatgtggaatcaacctaaatgccctcagtgacagattggataaagaaaatgtggcacctaaataccatggaatactatgcagccataaaagaatgaaatcatgtcttttgtgagaacatggatggagctggaggctattatccttaacaaactaatgcaggaacagaaaaccaaatactgcatgttcacacttacaagtgggagctaaatgataagaacctacaaacgaagaaaacaacagacactgggggctacttgatggggagggtgaaaggagcaagaggcgcagaaaatataactattgggaactgggcttaatacctgggtgatgagataatatgtacaacagacccccttgacacatgtttacctatgtaacaaaccttcacttctacccccaaacctaaaataaaaggtgaaaaacaaaagatgaggcaatactttgagtaatgcaataagaaaactgaaggagggtatagtagtacagcatccttttaggcaattctattattcttacaattttagatttttaaaaatatagttgggaataactgataaataatgatgaaataattttcaggatgatggattaccgaaagatttaaggtataggaaaaataagatcactgaggccctgtaatatatcttagatttatgaaagagtccaatggacccatatggtaattgcaagacaaaatgagtgtgttttaaaaacaagtaagagttctgtttgctcttgaatacctctaagaaagaataaattcatgaaatatcaatccttacaaatagaactgcccagaaacaaatttaaaaaacaaatctccagtctagtggtcccagataataccaagggataagtttgaagtgtgtattaaatatcccattggagatgtagagtagtggttgtctccagaaatctaaacctcagaagagaggtctagactagaggtttcagtctgagagtcatcaaccatttgaagctttggatctagatgagatcacccaggaaagagaggataaatggaaagagaagagggccaagaatagagccctgtggcacactagattttagaaatctcatttaggagaaagatactgagagggtgcaaccagtgaggtagaaacctgtgatataacttggagaatagtgttttaggtggggagaagtcaactggatcaaaagataagagtaatttttaaaaaagtaaggtcagagaagtttgatcattgacttttttaagaatagggatctttgatgacccttaggagagctgtttcattgaagtgatgaggctgaaagcctgtttgtgatggattaaaatgaggaagtagagataagcaatagaggcaaattttacaataaattttgctgtgaaggcgggggagagatggtatttggtgagagtttcttttaacccactttagaggattgagaggaattggtagagtacctggaattggggatgtcaatcagggagatattggtaccttaaattaacatattaaggcttgacattaatactctcacattaatactgtatagaatagagcagaattcttctctctccttttctcttttatggatgtataatagaggtacatagtttaggggtacatgtgaaaatatattcctataacttacagagatcaaatcagtgttcttgggatattcatcaccttaaatatttgtcttttctttatgctataaacattcaaattatgctagctatttcaaaatgtacaatagattaagttatagtcaccctactcaccctactgatctatcaaagagtaggtcttatttcttctatcaaaccatatatttgtacctattaatcaactcctcttcatctcttccttgcccatatacttcctggcctctgttaaccaccaatctactgtatctttatgagatccacttttttggctcccacatatgagtgagaacaagcaatatttgtcttttactgcttggattatttcttgacataattacctcccgtttcatccacattgctacaaatgacaggatttccttcttttttgtagctgaacattattccattgtgtatacatactacattttctttatccattcatctgttaatgagcacttaggttgatttatatcttggcagttgtaaatagtgctgcaataaacatgagagtgcggatatatctttgatatattggtttactttcatttggatatatacccagtagtggaatggcttgatcatatggtagttctattttttatttcttcaggaacttctatactattctgtgtagtgattgtatttatttacattcccaccaacaatgtataagggttcccctttgtttccatcctcaccagcattgttattgtctgtctttttgataaaaggcattttaactagggtgagatggtatctcattgtggtttttatttgcatttttctgatgattactaacaaggagcatttgctcacttacctgttggccatttgtatgttttattttcgggaatgtctgtttagatcttttgcccgtttttaaatcagattctttggctttttgctgttgtgttgtttgcgctccataaatattctgattattaatcccttgtcatatggataatttgcaaagattttctctcattctgtgggttgtctctttgctttgtggttgtttcctttgctgtccagagcttttagcttgatataatcccatttgtctatttttgctgtgtggccttgtgctttcgacatcctacacagaaaatcttggcccaggtcagtgtcctggagcatctccccagtgttttcttctagtagtttttcttcagttgttcgaggtcttagatttaagtattttatccattttgctttgatttttgtgtttggtgagagatagtggtatagtttcattcttctgcatatggttaatccagtttccccagcagcatctactgaaaatactgtcttttccccattgtatgttcttggtacctttgtcgaagatgagttggctgtaaatgcttgtatttatatctgtgttctttattctgttccattggtctatgtgtctgtttttataccagtaccatgctgatttggttactatagctttgtagtaaagtttgaagtcatgtagtgtgacccttccagcttcattctttttgcccagcattcctttggctatttggggtcttttgtgattccatataaatgttaagtttttttttctatttttgtgaagagtgttactggtattttgttagaaatagcattgaatctatagattgcttagggtagtatggacatagtaacaatattaattcttctaatcaataaacatggaatatctttcaatttttttggcatcctcttcagtatctttcatcagtgttacatagttttcaacatagagatctttcagttctttggttgattcccaggattttatattcattgtagctattgtagatgggattgctttcttgatttctttttcactttgtttgctgttggtgggtataaaggctactgatttttgtatgttgagtttgtattttgcaattttactgaatttgtttatctgttctaatagtttttttggtagaatctttaggtttttctgagtataagatcatgttgtctgcaaacaagactaatttgacttcttttccaacttgaatgtatgtcctttatttctcttgcctaattgctttggccaagacttccaagattaagtggtatacaagtggtgaaaatggatatccttgtcttgtttcagatcttagaggaaagatcttcaatatttcacctttgagtgcagtgttagctgggagtttgtcatatatggcctttattattttgagatatgttccttttataccctttgtgatgaggattttatcataaagggatgttgaattttatcaaatgcttatttaatctgttgaaataatcatagggtttttgtattggttctgttaattatcgcatttattgatttgcatacattgaaccatctttgcatccctgggatgaatcccacttaatcatggtgaatgatctttttaatgtgctggtgaatttggtttgctagtattttgttgaggatttttgcatctatgttcatcagtgatattggcctgtagtcttctttttttgttgtgtccttatctgtttttggtatcagggtaatgctggcctcataaaaggagtttggatatattccctctggttcaattttttgagtagaattgatatttgtttgtccttaaatggttggtagaatcatcaatagagccataaggttccacacttttctttgatgggagacttttgattacagcttcaattgtgttacttgttattggtttgttgaggttttctgtttcttcatgggtcaatattggtaggttttatatgtgcaagaatttactcatttcttgtaggtttttcaatttgttggcatatagtctctaatgattctatttctgtggtctgagttgttacatcttttcatttctgattttatttgggtcttttttttcttagtctagttaaagatttgtcaattttgtttatcttttacaaaaccaactttttgtttcattgatcttctgtattgttttttaagtttcaatttcatttatttctgctctaatcattattatttgtttccttatagtaattttgggtttgatttctttttgcttttctagtcccttaagatgtatcattaggttgtttatttgaagtctttctactttttggatatagatgtttattgctataaacttccctcttaatactgcttttgttgtatcccatacgttttgttatgttgtatttccattttatttatttcaagaaattttaaaattttttcttcttaatttcttcattgatcctttggtcattccagagcatattgtttaatttccatgtgtttgtgcagtttctgaggttcctcttgttattgatttttagttttattacattgtggtcagaaaagatacttgatatgatttctacttttctaaatttgttcagagttgttttgtggcctaagatatggtctcttctggagaatgttccatgtgctgatgagaagaatgtattctgcttgtgttggtgaaatgttctgttagttagacctagtgtgtagtttaactctgatgtttctttgttggttttctctctgaatgatctattactgagagtagggtgttaaaagttccctactattttttctttttagagacagtgtttcactctgtcactcaggctggagcacagtggtatggtcatagctctctgcagcttcaacctcctgggttcgagtgatcctcctgcctcagcctcccaagtagctgggattacaggtgcatgccaccacatatggctaatttttaaactttttaagtagagacagggccttgttatgttgcccaggctggtcttgacctcctggcttcaagcagtcctcctgtcctggcctcccaacatgctgagattgcaggcataagccatcacacctggctccctcctattattgtattgcagtccatctttccctctagatctattaatatttgcatatatacttcagagctccactgttgtatataaatatttataattgctatatcctcttgctaaaatgacctttctcattatgtagtgaccttgtctctttttatagtctttgatttgtagtttattgtatctgatataagtatagctattcttgttctattttggtttccagttgtatgaaatatcttttccacccttccactttctgtctttgtgtttctttataggtgctaagtttcttataggtggcataaagttgaattgtttctttatctgttcagccagtctttgccttttaattggagaattgagttcatttacattcagtgttattattaatatatagtgacttagtactaccattttgttgcttgtttgtaattcctctcttccttttttactgtcttcctttgtggttattttctttggtagaatgttttaattcattgctttttatttttggtgaatctattacaggttttttgcattgtggtcaccatgaggcttacacaaaacatcttataacaaggtattttaaagagatgacaacttatcttagatcacaaagaactgaagttttaattttatttaatataagttaaatgtaagtagccacacgtgatgagtggatactgtattggacaggacagctcaccacttttatcatgtgccagtaggtgaagaagggaagaattgggtagatcagagtttttccggtagcatctgcattgagatatgccgtaagtgtaaaacacatgctgaatttcaaagatataaaaaagaatgaatttgtcgtcaataattttaattattgattacccattgcaatgatgtaatatgaatatatttggttaaataaattattaaaataatttcacctattttattttatatttatgtaaccactagaaaatttaaaattctacatgtggctcacatttgtagatctcgtatttctataggacagtgctattctgacagtgagctccttatggggaaggacccttttcattttaatcttgactattactgtgtctttaatatagtagatacttaatagttgttgaatgaataacatagtctctagaaattgtgaccataagccttttgaagaattgaggctttgaattaaagcatatatatgatagatacatacataaacacacttgcacatacaggaagaaacctacatctaggaatacaagagtaatagcacttgttttgagccaaattctattaataattgaagaattaagttctcataacagcatctgtaagcaaaattctattaatattcctcatttacaggaaacagagacagggacattaagtaacaaaatgacacagaaatattaagtgatagaaataatttgaattcaggcagtctggctgtgtagtttgtacctttaaccagtatgctaaagaaatgtcatgtaattttggtcatccataattatcactttcaaaattgtgaaaggaggtgtatgaatgaatcctgggcagttttggacttgggggactttttgatgcctcttttgctttcctggaatgaagaaagtttacttaggccttacaatctgcttttaattgctttaagatttattaaagttcagcaagcaaagtctttttttttttctgttcggcatcagcttttatgtttatacttccagtaatatttttttcagctctgggaaaagtataaagaaagtgttgccactggtagtgtatgagtgaaaaattatcatttgacttttgggaaaatgaaatggttatttatatagtggtcccaagaatcaacttatctcttatattattaataggagagatttctgcttggtaatagatttataatactttactttttgggatgaagcaaaaaggcaagaatataagtttatttcccttcagctttctgttaacatttcccacagaaagttttatttcatatctaattgtaaatccagtatgttattattctgaataaatcttttataaataaatagttataaaacaggagggtataaggttcaaaggaaaagatgtattctttttcatttttaacatgctgccacaatttcccatatatgctaagtttatctgttttttctgtttacgtgattcttttcagtagtggcataccttttgctaattcacacacatttgtaagggtattcaggaaaacttagcttaaaaaatatgccatcaaaagattggagatggattctaggtagaaaaatgaatttatctgtaggcattatcatgttgcatgcagaaaatagtctttttttttttctctcttgcttgctcagtctgagctgacaggcagttctgaatattgggcagctctgtttcacactgccatccagggaccttgttttgtttcttctctcttgttctaccattccctaaggtgttgcatgtctgcagagatgagtctgaattgccaccaccaccacattcgcattctagtttgtgggaaaaggggaaaaaaacaagtggaaagcaagcagctttcaaaaaagtatgaagtttagaaaacttcacagttacacacaacacttcatgctataacctattgaccagaacttaatcacgtggacacatctatctgcaaatgtggccatcacctcacatggtaactatattaaaaaaaaattgagaacatttaagatctactcacttagcaaattttaagtttacaatgcagaattattaactatggtcaccatgctgtccattagatttctataatttattcattgtataactgaaacttagaatcctgtaaacaacatctccccatttcctcatcccctgatctcactcagtcccttacaaccaccattctactctctgcttctgagtttgaaaatattccatatataagtgagatggagtatttgtatttctatgctaggcttatttcactgagtataataccctctaggctcattcatgttgtttcaaatgacaggaatttcttctttttaaaagccaaataataatccatagtatatagccttttagtttgatgcaaagctatttgttcatttttgcttttgttgtgtgtgctttgagcatcatatccaaaaaactcattgcccagaccaatgtaaaaaagcttttccctgtgttttcttctggtaatcttacaggtcttacatttacgtctttagtccatttgagttggtttttgtttatggtctgaaatgagggtctaatactacagaccaaatggacctaccagatatataaataacattccagctgacagcagaaaatacattcttttgaagagcacatggaacattttccaggagggatcatgtgttagggcacaaaacaagttttaacaaattcaagaagattgaaatcatatcaaatattttcagccacaatggtatgaacctagaatcactaacaggaagaaaattgaaaaactcacaaatatgtggaaattaaacaacatactcctgaacaaccagtgggtcaatggagaaatcaaaatgaaaatttttaaaaattgtaaagaaaaatggaaacacaacataccaaaacttaagggatgcagcagaagcctttctaaaagggaagttcatagcagtaaacacctacatcaaaaaagactacaggaagacctgcttgaggctgttttacagttaccattttttttaacaaggagaaggagtacactctaaaaacaatgataaaagtataatatagtagatacataaaccagtaacatagtttttattatcattatcaagtattatttactgaatataattgtatgtgctatacttttatatgactggcaatacattaggttttttttataccagcatcaccacaaacaccttagtaatgtattacaatgtctacaacatcattaggctataggaattcttcagctccattataatcttatgggaccactgttgtatatgtagtctgttgttgactaaaacattattatgcacttcatgactatattgcattgctgtttctcctttcacttctgttaatacgtgctttgtttattaatatttagatgttctggtccatatgttgggtgcatatatttttacagttgttatatccttttgatgaattgactcctttattattacataatgacttttgtctcttgtgatagtttttgactgaaagtctattttgtctgacgtaagaatagctacctctgttctcttttagttaccatttgcttggaatatcttttcccatttcttcactttcagcctgtatgtgtgcttaaagctaaagttccttgtaggcagcatatagatagatcttgttttttttttttttttgagacagagtctcgctctgtcacccaggctggagtgcagtggcgcgatctcggctcactgcaagctccgcctcccgggttcacgccattctcccgcctcagcctcccaagtagctgggactacaggcacctgccaccacgcccggctaattttttgtatttttagtagagatggggtttcaccgtgttagccaggatggagatcttgtttttttaagccttcaaccattctgtcttttagttggagaatttaatccctttacatttaaaataattgttgataggtaagtacttaccattgctgttttgttaatttttttctgaatgttttgtagtttgtttcctcctctctttctaccttcctttggaatttgatagttttttttttaataatgatatgctctgattccttcttctttatgttattgtgtatctactacaggtgtgtgtgtgtgtgtgtatgtgtgtgtgtgtatttaccatgaggcttactgatattgtgtatctactacagttgtgtgtgtgtgtgtgtgtgtgtgtatttaccatgaggcttactgaatacatcttataacagtctattttaaactgataacaacttgacttcaaatacctacaaaaactttacactttaacttttgctcccaccacattttatgtaattgatgtcacagtttacatcttttgtattgtatatctattaacaaattattatagctaagttgttttaatacattttaaacttttatagtagagttgaaagcgatttacacaccactattacggtattagcatattctgaatttgaatttatagtaactttttaaaattcatgtattttcatgttgtcaattagcattctttcattttaagttgaagaactcactttagcatttcttgtaaggcaggttcagtgattacaaactccctcagcttttgtttttctaggaaagtctttatctctcctttatttctgaaggacacctttgctaggtatagtattcttggttgacacatttttttttcttccagtactttatttatttatttttttattatactttaagttctagagtacatgtgcacaacgtgcaggtttgatacataggtatacatgtgccatgttggtttgctgcaccgatcaactaactcatcatttacattaggtatttctcctaatgctatccctcccccagcccccccaccccctgacaggccccagtttgtgatgctctctgccctgtgtccaagtgatctcattgttcaattcccacctatgagtgagaacatgcagtgtttggttttctgtccttgtgatagtttgctgagaatgatggtttccagcttcatccatgtccctgcaaaggacatgaactcatcctttttttatgactgcatggtattccatggtgtatatgtgccacattttcttgatccagtctatcatcgatggacatttgggttggttccaagtctttgctattgtgaatagtactgcaataaacatatgtgtgcatgtgtctttatagcagcatgatttataatcctttgggtatatacccagtaatgggatggctgagtcaaatggtaattctagttccagatccttgaggaatcgccacactgtcttccacaatggttgaactaatttacattcccacttacagtataaaagcattcgtatttcttcacatcctctccaccatctgttgtttcctgaatttttaatgattgccattctaactggtgtgagatggtatctcactgtgattttgatttgcatttctctgatgaccagtgatgatgagcattttttcatgtgtctgttgggtgcatagatgtcttcttttgagacgtgtctgttcttatcctttgcccactttttgatggggttgtttttttcttgtaaatttgtttgagttcattgtagattctggatattagccatttgtcagatgggtagatcgcaaaaattttctcccattctgtaggttgcctgttcactctgatggtagtttcttttgccacgcagaagctctttagtttaattagatcccatttgtctattttggcttttgttgccattgcttttgatgttttagtcatgaagtccttacccatgcttatgttatgaatggtattgcctaggttttcttctagggtttttatggttttaggtctaacatttaagtctttaatccatcttgaattaatttttgtataaggtgtaaggaagggatccagtttcagctttctgtatatggctagccagttttcccagcaccatttattacatagggaatcctatccccatttcttgtttttgtcaggtttgtcaaagatccgatggttgcggatgtgtggtgttatttctgagggctctgttctgttccattggtctatatatctgttttggtaccagtaccatgctgttttggttaagtcaggtagcgtgatgcctccagctttgttctttttgcttaggattgtcttggtactgtgggctcttttttggttccatatgaagtttaaagtagttttttccaattctgtgaagaaagtcattggtagcttgatggggatggcattgaatctataaattatttgggcaatatggccattttcacaatatggattcttcctatctatgagcatggaatattcttccatttgtttgtgtcctcttttatttccttgagcagtggtttgtagttctccttgaagaggtccttcacatcccttgtaggttggattcctaggtattttattctctttgtagcaattgtgaatgggagttcactcatgatttggctctgtttgtctgttaatgatgtataggaatgcttgtgatttttgcacattgattttgtatcctgagactttgctgaagttgcttatcagcttaagaagattttgggttgagacagtggggttttctaaatatataatcatgtcatctgcaaagagggacaatttaacttcctcatttctgaaccgaataccctttatttctttctcttgcctgattgccccagccagaacttccaacactgtgtcgaataggagtggtgagagagggcatccctgtcttgtgccagttttcaaagggaacacttccagtttttccccattcagtatgatattggttgtgggtttgttataaatagatcttattattttgagatacgttccatgaatacctaatttattgagagtttttagcatgaagggctgttgaattttgtcgaaggccttcatctattgagataatcatgtggttttgtcgttggttctgtttatgtgatggattacatttattgatttgcttatgttgaaccagccttgaatcccagggatgaagcttacttgatcgttgtggataagctttttcatgtgctgctgggttcagtttgtcagtattttattgaggattttcgcatcaatacagggatattggtctaaaattctctttttttgttgtgtctctgccaggctttggtattaggatcatgctggcctcataaaatgagttagggaggatttgctctttttctattgattggaatagtttcagaaggaatggtagcagctcctctttgtacctctggtagaattcggctgtgaatccctctgattctggactttttttggttggtaggctattaatttttgcctcaatttcagagtctgttattggtctattcagagattcaccttcttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcactttttattgcatctatttgattctttttttctttattagtcttgctagcagtctatcagttttgttgatcttttcaaaaaaccagcttctagattcattgatttttttgaagggttttttgtgtctccatctctttcacttctgctctgatcttagttatttcttgccttctgctagcttttcaatatgtttgctcttgcttctctagttcttttaattgtgatgttagggtgtcaattttagatctttcctgctttctcttgtgggcatttagtgctataaatttccctctacacactgctttaaatgtgtcccagagattctggtaagttgtatctttgttctcattggtttcaaagaacatctttctttctgccttcattttgttatttacccagtagtcattcaggagcaagttgttcagtttccatgaagttgtgcagttttgagtgagtttcttaatcctgagttctaatttgatttcgctgtggtttgagagacagtttgttgtgatttctgttcttttacatttgctgaggagagctttacttccaattatgtggtcagttttagaataagtgtgatgtggtgctaacaagaatgtatattctgttgatttgggatggagagttctgtagatgtctattaggtctgtttgttgcagagctgagttcaggtcctcgatatccttgttaaccttctgtctcattgatctctctaatattgacagtggggtgttaaagtctcccgttattattgtgtgggagtctaagtctctttgtaggtctcttaaggacttgctttatgaatctgggttctcctggattgggtgcatatgtatttaggatagtttgctcttcttgttgaattgatccctttaccattatgtaatagccttctttgtgtcttttgatctttgctggtttaaagtctgttatatcagagactagggttgcacccctgcttttttttttttgctttccatttgcttgatagatcttcctccatccctttattttgagcccgtgtgcatctttgcacatgagatgagtctcctgaatacagaacactgatgggtcttgactctttatcgaatttgccattctgtgtcttttaattggggcatttagcccatttacatttaaggttaatattgttatgtgtgaatttgatcctgtcattatgatgttcgctggtttttttgcctgttaattgatgcagtttctttatagcatcgatggtctttacaatttggcctgtttttgcagtggctggtagtggttgtttctttccatgtttagtgcttccttcaggagctcttgtaaggcaggcctggtggtgacaaaatctctcagcatttgcttgtctgtataggattttatttctccttcacttatgaagcttattttggctggatatgaaattctgggttgaaaattcttttctttaagaatgttgaatatcggcccccactgtcttttggcttgtagggtttctgctgagagatctgctgttagtctgatgggcttccctttgtgggtaactcgacctttctctctggctgcccttaacactttttccttcatttcaaccttgatgcatctgacaattatgtgtcttggggttgcacttcttgaggagtatctttgtggcgttctctgtatttcctgaatttgaatgttggcctgccttgctatgttggggaagttctcctggataatatcctgaagagtgtttgccaacttagttccattctccccatcactttcaggtacaccaatcaaatgtagatttggtcttttcacatagtcccatatttcttggaggctttgttcatttctttttactcttttttctctaactttgttttcttgctttatttcattaatttgaccttcaatcactgataccctttattccacttgattgaattagctgatgcagcttgtgcaggcgtcacgaagttctcgtgccatggttttcagctccatcaggtcatttaaggtcttctctacactgtttattctagttagccattcatctaatcttttttcaaggtttttagcttccttgtgatgggttcgaacaacctcctttagcttggagaagtttgttattaccgaccttctgaagcctacttttgtcaacttgtcaaaatcattccctgtccagctttgttcatttgctggtgaggagctgcaaacctttggaggagatgaggtgctctgatttttagaattttcagcttttccactctggtttctcctcatttttgtggttttatctacctttggtctttgatgttggtgacctacagatggggttttggtgtagatgacctttttgttgacgttgatgctattcctttctgttagttttccttctaacagtcagttccctcagctgcaggtctgttggagtttgctggagttccactctagaccctgtttgcctgggtatcaccagcggaggctgtagaacagcaaatattgcacaacagccaatattgctgcctgatccttcctctggaagcttcgtcccagagggtcagctgtctatatgaggtggctgtcggcccctactgggaggtgtctcccagttaggctacgcagggatcagggacccacttgaggaggcagtctgtctgttctcagagctcaaatgctgtgctgggagaaccactgctctcttcagagctgtcagacagggacatttaagtctgcagacgttttctgctgccttttattcagctatgccctgctcacagaggtggagtctagaggcagtaggccttgttgagctgtggtgggcttcacctagttcaagcttccccaagccgctttgtttacctactcaagcctcagcaatggcagatgcccctcccccagccaggctgcagtctctcagatcaatctcagactgctgtgctagcagtgagcaaggctctgtgggcgtgggagctgccaagccaggcatgggagagaatcaccttgtctcccggttgctaagaccttgggaaaagcacagtatttgggcgggagtgtcctgtttttctaggtagtctgtcatggcttcccttggctaggaaagggaaatcccctgatcccttgcgcttcccaggtgaggtgacgtctcgccctcctttggctcactctccatgggctgcacccattgttccaccagtcccaatgggatgaaccacgtacctcagttggaaatgcagaaatcacccgtcttctgcgttgatcacgttgggagctgcagaccagagctgttcctattcggccatcttggaatgcccctcccttcctcttcttcctgtactttaaatatgtcatctcattctctcctggcatgcaaagtttctgctgagaaatatactcatggtcttaaaatcgttcccttgtatgtgactagtcatttgctgctttcaaaattctctccttgtctttgacatttgagaatttgattaaaatgtgtcttggtaaagatctctttattattaatctatttcaggttctttgggcttcatggatttggatgttcatttttttcttccagatttggggtggttttcatcattatttctttaaataaactttatgccccttctctttctcttttatttctgtaatacatatattggttcttttgatactccataagtgccatagactatcttcactctttttaactccctttgctttttgttcctctgactgggtaattttaaatgaaccatcttacagcttgctggttcttctttctgcttgatcaagtgtgctgtcgaaagctctctatggaatttttcagttcattcattgtattcttcagttccagaatttctgtttgtttcttttttgtggtttctatttcttttttgattttttttattttgttcatgcattgttttcctgacttcatttaattttctatctggattctcttgtagctcactgagcttcattaagatgtttgttttgaattccttgtcaggtaatttgtagatctgtatttctttagggtcatttagtggtgcttcattttgtgcctttgtggtgtcatatttccctgatgattcatgatctttgttgccttgcattagtatctgcccatttgaagaagtaggcacctcttccagtctttactgactagctttggcagggaatgccctgcaacagtcaactatttacagattctggttaggccattttgcagggcctatagggagggcttgcctagtgcctgggtctgtgggggctggcctggtactggggggagttctacagttaagggctgtctggccgagtgcctgggtccacaggggcaggccaggagcctggggccatgagagctgacgtggcagtggaatggccctggaatctgggtccacaggggttgacctggatgttagctctgtaggagtggacctggagcctggggctatagacattgacctggtgctaaggtctgtggtgaagtcatgtgctcacgttactcttcttgccccatacaaagggtatttctctttacactgtgctgtgcagggtaggaatgaatgatacaggtaatgtgaaactgtccttaccgtcttcagtgtgccttcttatttccatgcttcactgaggtgctatactttctcacctggattcctcaggtcttgtgaaagtttttttttgtgcatggattgttgttcaaattgatgtttctatgaggggacaagggctggaaactcctattctgccatcttactgatggcactctagtgtgacttttgaatccgccagtaggaaaccttttatcatcctaagaagcacagatgtgtttagctattttatttgaatttggaaggatagtcagaaggacctggtccacaaaagccagaagaagggacttgattctcaatatactactatttaataaagtcagaattggaaagcctacagattcctgtttcatattatcactacatccatattacttatactatgcatctctcttctttccttttctagaagcattctttttaaaggcttgcttgctttttgttttgttcctaattttcctagttttcttcaaaaatttcctgccatttagtaatgcatattgcttttctagaattatgcatctcagcaaagattacatgaggattcagaaatactttttagcatgacttctatttcttttataccccaaatcttataaacctagttaggtccgcctttgtagttcactgtctaaatctattttcttatattttgattgttcaggtaaaggttttattctaaaataatgaacactatacattgacagaaacaaatggatgaatttcaccagagttactacattcaattatgttagctatctaattcactatatatataaagcttgtagctttgaactaattagggttgtagatttttacctttgtttttttttcttttttgaaaaagagaagcaagcttctgtcttgatttttaattctttaatttagtgcaactgtaactggtggcatgaatttgttattactattggcaaatttctaaatcttgtaacccaaattgctcattctatttttttcagatcaaagccagtgtttaccatgcaatcccataaacaactgcataataaacttaattctatttttgtatttgtttttagttgatgctgtaacaaatcaccacacattcagtgacttgaacaacacaaatttcttaaattatggttctgcatgtcagaagtccaacatggatctcatggggccaaagtcaagatgtcacaggactatattcctttctggagatattaggggaaaactcatttccctgctcaaggtttagacaagctctttctcatttctctttcattctctcttttttttttcatctctttcaatatgattgtaatcccatgaaacatagttcagcattcaggaagaaacaaacttaaactatgtaataatcattaatttatgtaataaacttaatataaaattaaatttaaatatttaagattataactataagataaaaactgtgagttttatctaactcacagtattccaattttctaattatttccttaattgtgatactcagaagacaggagagagagactttactgttgatggtgatggtgatggctgttatgatgttgaacttttgagggtcttagtttcccttttatacacatgtaagtcatccggtagtcttttgatagttgtcttagttattaagatatttgagagtttcctatttaattcagtttgttcagcctattttttttttcattgagatagggtctcactctataactcaggctgccacagcctcaatctgccaggctcaagtgatccttgatccacctcagtctcctaagtagctgggactacaggtatgcatcaccacacctggctaatttttttatttttcatagaggcgaggtctcactatgttgcccaggctggtgttgaactcctaagctcaagcaatcctcttgcctcagccttccaaagtgctgggcttgaaagtgtgagccactgcaccagacctcaacctacttttttttttttttttttttttaaccactggagatcttattttctgactaaatctaataattttttatggaaaatgtaagtatatttgtgaattgacagtagggttaaaggcatgatgccctttggaattgctttgttaacatcagaagcaatatctaagatccccctttttttttttgagacaggatctctctctgttgcccaggttggaatgcagtggcatgatcttggctcactgcagcctcaacctcctgggctcaagccatcctcccacctcagcctcctgagtagctgggaccacaggcatgcactaccatgcccaactagtttttttgtgtattttgtagagatagggttttaccatattgccactttctgttttcgaacttctgagctcaagagatccacccactttggcttcccaaaatactgggattacagatgtgagccaatgtacccatgcagatccttttcttaccttttaaaagattactggaaaatttgaacatgcctcaacattttaacatatgtgaatgccattttgatatgaatgcaaagtggtgctgatatttacatatgggatctatccgtagtaactgacttttgatgctctttctttttagaggttgctgtggactgaatgtttgtgtctccccacaatccctatgttgaaacctaatccccaatatgatgatatctggggattgaggctttgggaggtaatcaggtaatgagggtaaagccctcatgatgggcttagtgccattataaagagagacccaagagagtttgatttctctctctgtcctctggcttgtgagggcacagcaggaagacagcaaaccagcaagagtcatcaccaaatgtgaccatgctggtactgattttaaagtttcccccgtaattgtgaaaaataagtttctgtttaagcaacccaacctgtggtattccgttatagtagcccagactaagacagagatgtttaaattttattgtgctattaaataaaagtaccggtgcctcaaagctctgttgtttagatctaaaagatctaaaggtatgaaatgaatattgttgaggcaggatgaggtggtttggatttgtttatttttctccaacttttattgtgaaaaatttcacacgtcggaagagttgcaagaatagaacaatacagtacaatagtaccagtgtgtcttaattattattttgctgcaaaagcacacttgtactttttctctctaatgtgattgtgtgtgtgtgtgtgtgtgtgtttatctgttttcttccctgacccatttgagagtgagttgcagatattttacctccaaatattttagcatgtatcccatttaggaagtttaacattgatacaatattatgtatcatatcgttcatatgcaagtttctccagttttcagatttagaaatagcaaatgattctaaaagggcataattactttgaaaaattgaaaatcactttgaaaaatctggagttttaaagatgatttaccatatgggaaactgtggcaaattttaaatgaatatcctgaagtatgattctaatccagattgaattcaagctgtgaatttttgttttattttctaaatttttttatttcagtagatttttgggggaataggtggtgtttgattacatgaataagttctttagtggtgatttctgagattttagtgcacccatcacccaagcagtgtacactgtacccagtgtgtagtcatttatcccttgccacccctcaccctttacctccagtccccaaagttcaatatatcattcttatgcctttgtatcctcatagcttagctcccacatatgagtgagaacatacgatgtttcgttttccattcctgggttacttcacttagaataatagtctccagttccatccaggttgttgcaaataccattatttcattattttttatggctgagcagtgttctattatatatatatatacctacctttctcccttcccttccctcccctcccctcccctcccctcccttcccatcccctcccctcccctcccctcccctcccctcccctcccttcccttcccttcccttcccttcccttccacagagccttgctctctcaccaggctggagtgcagcagcatgatcttgtctccctgcaacctctgtgtcccgggttcaagcaattctttggcctcagcctcccaggtagctgggactacaggtgtgcgccaccacgcccagctaattttttttggttttgtatttttagtagagatggggtttcaccatgttggccagggtggtcttgatctcttgaccttgtgatctgccggctttggcctcccaaagtgctgggattacaggtgtgaaccaccacgcctaacccatatataccatattttctttatccactcattgtgatgggcatttgggctggttccatatttctgcaactgcaaattgtgcgctataaacatgcatgtgcaagtatctttttcttataatgacttcttttcctctggatagatacctagtagtgggattgctggatcaaatggtagatctacttttagttctttaaggaatcttcacactcgtttccatagtgattgtttgcattcccaccaacaatgtaaaagtgctcctttttcactgtatccatgccaacatctattattttttgatttttttgattatggccattctttcaggaatgaagtgatgtcacgttgtggttttgatttgcatttccctgatgcttagtgatgttgaacatttttccatatgcttgttggccgtttgtatatcttcttctgagagttatctattcatgtccttagcccacttttttttgatggaattgtttgcttggttttttttcttgctaatttgtttatttgtagattctggatattagtcctttaccagatgtatagactgtgaagactttctctcactctgtgggttgtcaattaactctgctgattatttcttttgcttcgcagaagctttatagtttgattaagtttcatctacttatatttgtttttgtcgcatttgctttcgggttcttagtcatgaagtctttgcttaagccaatgtctagaagggtttttccaatgttatcttctagaatctttatgatttcaggttttagatttaagtgtttgatccatcttgagttgatttctgtataaggtgagagatgagtattcagtttcatttttctacatctgacttgccaattaccctggcactatttgttgaatagggtgtcttttccctactgtgtgtttttgtttgctttgtcaaagatcagttggctttaaatatttggctttatttctgggttctctattctgttccattggtctttgtgcctatttttataccagtaccatgctgttttaatgactatggccttatagtgtagtttgaagtcaggtaatgtgatgcctccagatttgttctttttgcttagtcttgctttggctatgcgggctcttttttggttccatatgaattttaggattgttttttatggttctgtgaagaatgatggtggtattttgatactgcattgatattgagaattgcaattccagtttgatattgggaattgcattgaatttgtagattgcttttcttttggccgtatggtcattttcacaatattgattctactcatccatgagcatgggatgtgtttccatttgtttttgtcatctgtgatttccttcagcagtgttttgtagttttccttgtagaggtcttttacctccttggttaggtatattcctaagtttgtttgtttgtttgttttgcagctattgtgaaaggggttgagttcttgatttgattctcagtcaagctgtgaattttcaatatatttttgggcataaaaactatctttaaatggtgtgaggacttactatgtatattttgatgttttcttatagtttatatactttcttgtgaagacaaaaatagggggtcttcaaagtcttttttttttttttttttgagacagggccttgcgatttcacccaatctagagtgcaatggcatgatcatagctcactataaacctgacctcctgggcttgagtgatcctcccatcccagcctcctgagtggctaggactacagtcatgtgccaccacgtggctttattttttattttttcgtggagacaggatcttgctatgttgtgccaccacatggctaatttttaatttttttgtgtgtggcaacagggtcttgctatgttgcccaggctggttgcaaactcttggcctcaagcaatactcctgccttgactttccaaagtgctaggattacaggcatcagccactgcccccagcctacaaagtcttgaggtacgaattaggggaaggtttcttgtcaagttttcttttaactctaaaattctatggctttcaataatttaacagatatttaaactattaaatatgtaacattgtattgggtgctctaggaaatgtggataatccttgatcaccaagaattcaagggaattaagaacttatttacaaataaatgcatgaaagtaaactgtatatgaagacttgtaagaaatattttaacaaagtgcagtgaaaattcagagacagaagaaacttggctgggtggtaagaatagaacagataagcttcattggattgtaaatacttgttaacagaaatccagggtctctactataattttcctgtgtatacaataattttaactggaattaattgtattaacccatttatgccagaagttgcaaatttttttttgtgaaaaatcagatcttggtgataaccttgagcagtaggataaaaataactcccacaagcttagtgttccagtaatggaacactaggcataaatgtattaataagcatgaggtatgcataattcaattagattaaccaaaaatagggaaatacttatgtttgtgatatattgcaagtaaaaattattgaaatttttattgaaaataatacattataacaaatttaagtgtagtaaagtagaaattaaaaagaaaaatgtcatctatagccacctcattcatagataatacctattgacatctgttttttttttcattttttctatattgtgtgcatgcttatatttgatgttgcattctgcttcaaattagttgataaaataattttttttcactttagtaccacacttttgcaagcaattttattggcagcataatattatattgagtagttgtggcatgatttactaaaacatttttctattgtttaacaaaataattaattctttgtaggaacaagcaactgtagaaatggtaaagttatgatagagaacaaacttgttccaagatctcttggaaggatcttccttaattttttatcctgacaatttaatacaccaaatattttacatgatttttttcttgcttttttttactactattttaacttaccgttattaaattatttacgcttttcattacatctagtttagaaaatttagtgtttcattgactatttggaaagattattctgtatatgctcagagaagtggtagaagcatcaagccagctgatgtggatcccaaagggtttggtgcaggaacatctgtagtggtgcatggccagggacagccatccccataggctcaacttgctcctataggagtctttagtgctaggggaactgtcagtcctcaactctgcaggatggtcttgcccatcagatgaggcaggtccaacctgagcgccccttggtctgctgacccctcccaggccccattcctgcttgcagggcagcctcaggtgccctggggggcctgcattatagcttctgtactggtagaccatgggtgatcagtggagagtttcagcagggtggtttctgtgggcatgaaccagcctgcatactccctccctatgttgcagtttcccctaacccatggcaacttactcagctggcatgtatctgtgtgggtgagttttgctttcctttgccacaccagtgtgagggagtgcagtccgaccccctccacccaccaactgccattgcaggcagagccttggcagacacagccagccttctccaaccagcagcctgcccttgcactaacactgctgtgggagtcaaactaggcacagagaacagcagatcctccccagccctgagtgacaactcctgcttgcagggcacagagaaggcacccagacctgcacctgccagtaccccacccctgagccaacaccatttctagcatgactgtgcgcacagtcaccagcaggggccccctgcgccctgctccagctgcattcccttcactactctggtgaacacccacatggagacaggcatcctggcacctactagcactctgccacagctgctgctaccactgctgctggcacatgcaaatgaggatggatcctgctgtcattgcactatgaaatgctttcattcacaccacctatcagagtgtagtgaccagcggtctgggaacaccttaggccccccccgaccccagcacagtggatttctaacctcgaggagccagagaacaaagagccaatgcaagtccgccagagttagagcacacagtcctggagttgagagctgagcagtggccctctaacaccttccagaaatgaagccagtctgctgaattcacctataccacagtcaaactcttatggtcatcaaatagaataaaaggaaaaaacaaacacccaaaggtcagcaacctcaaagattgaaggaggataagcccacaaagatgagaaagaatcagcacaagaaccctgacaactcaaaaagccagagtaccttctttcctccaaatggtcacatctccgttccagcaaggattctgaaccaggctaagatggttgaaatcacagaaataagattcagaatgtggataggaacaaagctcattgagatacacgagtatgttgaaacccaatccaaggaagctaaaaatcaggataaaacaatgcagaagctgatagacaaaatagctagtatagaaaagaaggttacaacccaacagagctgaaaaacacactacaagaatttcataatgcaattgcaaccattaatagcagaatagaccaagcagaggaaggaatctcagagctagaagactggctttctgaaataagacagataagaatagaggcaaaagaatgaaaaggaaggaacaaaacctccaagaaatatggaattatgtaaagagaccaaatttatgactcattggtgttcctgaaagagatggggagaatggaaccaacttggaaaacatatttcaggatatcatccatgagaacttccccaacctacctagagaggacaacattcaaattcaaggattgcagagaacccaagtaaaatacttcacaaagaagatcatccccaagatacatactcatcagattctccaaggtcaaaatgaatgaaaaaaatgttaaaagaagctagagagaaaggtcaggtcacctacaaagggaagcccatcagactaacagacccctcagcagaaaccttataagccagaagagattggatgccaatgttcaacattcttaaaagaaatcccaacccagaatttcatatacagccaaactaagcttcataagtgaaagagaaataagatccttttcagacaagcaaatgctgagagaattcattactaccagacctgccttacaagagcccctgaaagaatcactaaatatggaaaggaaagactgttaccagccactacaaaacacactgaagtacacagaccagtgacattgtaaggcaactacataacaagtctgaaaaataaccagggtctgtgacagtgtcagatccaaacatactaatactaaccttgaatgtaatgagctaaatgccccaattaaaaggcagagagtggctagctggataaagaatcagacccattggtatgctgtcttcaagagaccagtctcacacggagtgacatacataggctcaaaataaagggatggagaaaaatctatcaagcaaatggaaaacagaaaaaagcaggggttgcaatcctagtttcacacacaacagactttaaaccaacaaagatcagaaagatcagaaaagacaaagaagggcattacataatgataaagggttcaattcaacaagaagtgctatatcctaaatatacgtatatacacccaacacaggatcactcagattcataaagcaagttcttagagaccttcaaagacagattcccacacaataatagtgggaaagtttaataccccactgacaatgttagataattgagccagaaaattaacaaagatattcaggacctgaactcagcacaggatcaaatggacctgatcaacatccacagaactctccaccccaaaaaaacagaatatacattcttatcattgtcacatggaacatactctaaaattgatcacataagtggaagtaaaacactcctcagtaaatgcaaaagaactgaaatcataacgaacaatatcttggaccacagcacaaattagaaatcaagactaagaaattcactcagaaccatacaattacatggcaattggataacctgctcctgaataaactcttggataaataatgaaattaaggcagaaataaaagaagttctttgaaactaatgagaacaaagagacaacataccagaatctgtgggatacagccaaggcagtgttaagagggagatttatagcactaaatgcccacatgaaaaagttggaaaggtctcagcttgacaacctaaatcacaactaagagaactagtgaaataagagcaaagaaatcccaaagctagcaggaaacaagaaataaccaaaattagagcgaactgaaggatatggagacatgaaaaaccattcaaaagatcagtgaatccaggagctggttttttgaagaaattaataaaatagaccattagctaggctaataaagaaggaaagaggaaattgaaataaatgatcagaaatgacaagggtgatattaccagtgaccccatgaaaatataaataaccatcagagaatattatgaacacctctgtgaacataaactagaaaatctggaagaaaatggataatttcctggacccatataccctctcaaaactgaaccagcaagaaattgaatccctgaacagacaaataacaagctctgaaattgattcagtaataaatagcctaccaaccaaaaagagcccaggactagacagattcacagctgaattctaccagatgtacaaagaagagttgataccattcctactgaaactattccaatgaagttaaggaggaggaactcctctctaactcattctatgaggccagcatcatcctgaccaaaacctagcagagacacaacaaaaaaagaaaactttaggccaatatccttgatgaacactgaagcagaaatcctcaaggaaatactggcaaatcaaatccagcataacatcaaaaagcttatccaccatgatcaagtaggttttatccctgagatgcaaggttggtgtaacatatgcaaatcaataaatgtgatttatcacataaacacaactaaagacaaaatccacatgattatctgaacaggtgcacaaaaggctctcaataaaattcaatactacttcatgttaaaaactctcaataaactaggtatcaaaggaacatacctcaaaatagtgagagccatctatgacaaacccatagtgaacatcatactgaatgggcaaaagctggaagcattccccttgaaaacttgcacaagaaaaagatgccctctcttggcatcctttttccattctcttggaaaagaataccactcgttttcaacatagttttgaaagtcctggtcagggcaatgaggcaagagaaagacagagcatccatataggaggagaggaagttaaattatctctttttgcagatgacataatcgtatacctagaaaacaccccagtcccagcccaaaagctcctccagctgatacacaaattcagcaaggtctcaggatacaaaatcaatgtgtaaatatcaatctttcttatataccaacaacagtccagctgagaaccaaatcaggaatgtaatcccattcacaattgccacaaaaagaataaatacctagaaatacagctaaccagggagatgaaagatctctatgaggagaactacaaaatattggttaaagaaatcagagatgacacaaacaaatggaaaaacattttatgctcatggataggaagaatattgctaaaatggccatactgcccaaagcattgtatagattcaatgctattcctgttatactaccatttacatttttcacagaactagaaaaaactattttaaaattcatatggaaccaaaaaagagcccaaatagccaaggtgatcctaatcaaaaagaacaaagctggaggcattatgctacctgacttaaaaccgtactacagggctacagtaaccaaaacagcatgatactgctacaaaagcagacagatagaccaatggaatggattagagaacccagaaataaggccatacacctacaactatctgatcttcaacaaacctgacacaaacaagcaatggggaaaagattccctagttaataaatggtgctagataactgactagagatatgcggaaaattgaaactggatgccttccttacaccacataaaaaattaagctggattaaagactttaaaatcccaaactataaaaacgttggaagacaacgtaggcaataccattctgggcataggagtgggcaaattttcatgacaaagatgccaaaagcagctgcaataaaggtaaaaattgacaaatgggatctaattaaacgaaagagcttctgcatagtggaggaaactatcaacagagtgaacagacaacctacagagtggcagaaaatatttgcaaatgatacatctgtcaaaggtcaaatatctagcatctgtaatgaacttcgatttacaagaaaaagcaaccccattaaaaagtgggcaaagagcatgaacagacagttttcaaaagcagacatacatgcaatcaacaatcatgaaaaaagactcaacatcactaattactagagaagtgcaaatcaaaaccacagtgagatactgtcccacaccagtcagaatgctattattaaaaagtcaaaaaacaacagatgctggtgaggttggagagaaaaaggaacacttatacgctgttgatgggaatgagtgtaaattagttcaaccattgtgggagacgatgtggcaattcctcagagacctaaaaacagaaatgccatttgactcatcaatttcatgactgggtatatatccaaagatttataaatcgttctattataaagacacatgcacttatatgttcattgcagcactattcacaatagttcgcaaagacatggaatcaacccagattcccaatgatagaatggataaaggaaatatacaccatggcattctaagcggccatcaagaagaacgatcatgtcctttgcaggaacatggatggagctggaggccattatccttagcaaacaaacacaggaacagaaaaccaaataccacatgttctcacgtacaagtgggagctaaatgatgagaacacgtggacacgggaacaacacacgctggggactatcggaggatgaagggtgggaagagggagagaatcaggagaaataactgtgtactaggcttaatacttgggttactaaataatctgtacaacaaacccctatgctacaagtgtactatataacaaacctgcatgtgtacccttgaacttaaattttttaaaagtttattaaggtgaaaatggttattgaaaaatcttaatctctgaattagtaacagttcccacatgctaaatgatgtatcccaatatctctttatttaaaatataaaactaggcagaaactgaaattattttctagtaggagagtcttttaaaaggtagcattcataagtgttgtttacatattatgcatgggtcactgacaatcaatgtgtctgtaaacaactctgttgtagttagggctcttttcccttttgaattttgattgctcagccaagggttctttgttgatagctggtttgagtacttttatatactatacttaattcagattaatgagctttgttaatactgatttgaactagctagattttatttgtttacttgtttttgttatttttaagaacgaccaattccagatctatgctaatttaaatatgtcctcaaaaagggggcacatatttaaaaaaacaaaccaaaacatacatttatgttggaaaaatcttcttagttcattgttagtaccctaatttttgtaggttttcataggaattaactctttcaaagcaccttttagactatgttgtcggcagctagatgctccatttacttcaagaaatgcaacaaaattgaaaccagtttaactgctaagtgattcgaagtaatgcaaagtacatggactgctaaatcatagaggatctaatttttttttaaaacccatttgttaggctctcatataaatataacacttaaaacaataagcacatatactgttatataattcaggaagatttttagcttgtagacttccaaagaatgtggcattttgttttagtttttgaagtacctcttttttttttttttaatttcagtaggttttcggggaatgggtgttgtttggttacatgaataactttagtggtgatttctgagaatttggtgcacccatcacctgagcagtgtacactgtactcagtgtgtagtcttttatccctaactcctcttccaccctttcccccgagtccccaaagtccattgtacgaagatactgtacctttcttttaatgccagtttataatgcatgttcgaacttttaacttcactaagtctatgaaggtaagatatacatagtaagaactaaacctgctaaagatcatcctgtttatgcaacatcattaatttaacaaataagcagagtaatgcatttaggacaaaagtttatgtttgttattagggatataaagtctgttatccccaggatcttagagactaagagagtagtataaacaaatatttatagtaaactctgtaattactatagaaaatatcacagaagcacaacagctcagctaactctgccatattaaagtagagcagtattatgactgaataaatcaaaacagctgacatcattagacctgctatgattgataacaggtttttctctttgacaagtggttgtgatatatgtaagaattcctagtttttctttaatatgatagataaacctgactaatgattttgaagcatttagtggttgaaatctttctgtgagctttttgtttatcttttatttttagcctgatagtctgataaaggaactgtgctttaatttgcttcttttttgcttgttgctaatgctttttatgatttccaaatatttcaacttcattgttgaaaaatgaacatattttcaggtagatattatattttaatggattacaacttagattttaaatttgctgaaatttttctttgccaggggtaaggtttctggtcaatataaatagaatcatcatgtgtttctgtctccaaaaagttagctgcatattttctgaatttgaggtttgaattaagaattgggaatgccaattgatagatggatggttaaatgcttatgatagctcactgtctatgaaatcctatatgtgtttgttaaatgtgaccgtcagcactaagtaaatcggtaaatagattactttcccaccctaaggatctgcagagtgtcttagaatttcacaaaaggagcaaacctctgacttgatggaataaattttgataatcagtttcttgtttgtttatctgtttattgatctatttcttagtataattatgattgcattttatattggacttttgttttttacctttttaaaaaaaccacattgagccaattttcaattgtttaaactttcagcatgtttaaatatttgtgtttatagttttcagaatttttgctcagttttggaatagtaccgattaccaaaggtaaacctgacccttaatgagcaagtaaatttgtaggctgtatacatttttttaaagtaattgttatctaggccacattagccttcaagctacattgtctattgactgaggctccttagatctcttataaaatgcattatattgcctgacttgcatattatattatctaggtaaagcaatgtaattaaagcttaactgaggtcatgggtggtggctcacacctgtagtcccagcactttgggaggcaaaggcaggcagatcacttgaggtcaggtgttcaagaccaacctgggcaacgtggggagagcccgtttctacaaaaatacaaaaattagctgggcgtgatggcgcatgcctgtaagtcccagctacttggaggctgaggtgcgtggatcacttgatcccaggaggtggaggttgcagtgagctaagatcacaccactggaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgatggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggagcagggcacagacaaacaaaaaggcagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcctatcagactaacagcagatctctcggcagaaaccctacaagccagaagagagtgggggccaatattcaacattcttaaagaaaagaattttcaacccagaatttcatttccagccaaactaagcttcataagtgaaggagaaagaaaatactttacagacaagcaaatgctgagagattttgtcaccaccaggcctaccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaatattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaatcgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaacaggaagaagttgaatctctgaatggaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactaccttacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcactcgtatgtttattgcggcactattcacaatagcaaaaacttggaaccaacccaaatgtccaacaatgatagactggattaagaaaatgtggcacatatacaccatggaatattatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggaggggtagcattgggagatatacctaatgctagatgacacattagtgggtgcagcgcaccagcatggcacatgtatacatatgtaactaacctgcacaatgtgcacatgtaccctaaaacttagagtataattaaaaaaaaaaaaaaaaaaaaaaaaaaaaaaaaaaaaaagatcacaccactgcactccagcctgggtgtcaaagcgagaccctgtctcaggaaaaaaaaaaaaaaaaaaaaaaaaggcttaattgattgaaccagattcgagaaaacagtgctaaattataattttctcaatactgtaaatatttttcaatcttcagcttcattaacttctataatttgaaattatcccaattattacctgacatgtactaaaattccctaaaatggatcttgagtaacattttcacagtacgataatttttctctctgtatatatttatatagtcacatatatgcacatacattatacaagcattacttttctataactgtaaggtcagaatttgaagttgtgttttctttatctttttatttccaatacttggcatcaagttgatattcattagaagtaaaggaggaaggaaatgaataatcttcagatactaagaacattacacttaaattattattaaatctaatttgcattctcatatattggcttagcttggttatttgtaacaagaatataaaaatatatgtgactgggaatgacatgaatagaaacttctggaaaatggaatggtaaggtctagagaagtggtaaatatttcatcactggaaatgagcaagcagaggttaggttattctttgacattgatattgaagcagagagtctctataatggatagaaagttcaaagtgacctttaggatcttttatcttcaaatttctatgaaaagtatatttactttaataataaggttaagatgttggagtgcatagagtaaaaaactagaaaagaaccagatgttagaaaggagatttcttaacaaaatacggttaaagaggatttctcatattttatatggaaagaaggaactttgatatttaagtaggaaccatcttctaggggaccctgttgattaaacaggaaatctagaaactagacaaagaaaaaaagaatttggctatatgaaagttaaaacttatattgcaaaagagaacataaaattaatagtccaaataaaattcagaaaataaaatatttgtaacagagatgccagataacaaatttgtatctataatatggaaacaactcttataatttgtttagaagataacccaatggataatgggcaaaggatatgaataggcaattttggaagatcaaatttagatggtcagtaatgtttcaaaagatgctcagacttattaactgttagtgatatgcaaattaaaataacaccaaactatcattttacatgcataaggttgtcaaagattaaaatagtcaaaacacttactactttggcatggggatgtgggaagtgatttgaatacattgctgttggaaatgtaagagttattttatctcttttttggaaggcaatctggcaatatttattaaaatggaaaatacacatactctatgctccagtaattccacttcaggaaatatatccctaagaaataaaagtactggtatgtacaaggatgtttatttcagcactgtttataatatcaaaaattacaaacaaaataatgcttattaatgggatgggtaaataaattatagtatattgcggcacagatcattatattactatcacaaaaagcactatatgaattagagggactttctgtgaggtactgttgaatgaggaaagaaagatatacagaagtatgtattaatatatccaattcttttgtagaacagtgaccaaaatcctgtgtgtgagtttatgtatgagtgtgtgaacctacacatttatatgttcatatggcagggcagtatgtagcaaaagagaagaattcatactcagtggttagcatgtttttagagagttataataatacaacaggagtaggaaggaaaagggaggtaggcccataccaggtaattagatgtgagaatggaactcaaagagcaagtcaagactcaagatttaaatttgggagtgaactatagaggcaatattagatgctaacaaaaccgaatgtaatggctaaccctttaacatctatctgtattttttgtcctatattttaatcagtttctgcttcaccttggtcagcaaaagctcagcaataggttttgtaatattttctgttttaactagctcaaataaacacatattaattgaaaacttctaacagcttttatttattcaacaaatatttcttgatcacctgctttctggcaggcattgttatggcccctgcaatgacaaataagacatacagggtccctacataataaataaataaataaataaataaataaataaataaataaatatataatgtcagatcacataaaagctatgaagaaaaagcattttttcaacggataataagggacagagcagggaagggaaaaggagaggaggtttaactattttggataaggtagtgaggaaaagttttctttcagaaggtgaatttgacaaaagagctgaatgaaatgaagaaccagcccaactgtatatctgggagaagaacctgtcagtcagatagaacaagtaagaagaccttgaggccttgacttattctagaaacttgaagaccagagtgactaaagcatagggacatagagtgtgaaaagatgagttccaaaaggtaggtagggcctgatcttgtagggcgttgtcacccttgtaaggagacaggattttattctggttgtgatgggaagctgtggagggttatgagcactggaagattatgacattggaggctgtgctaatttggatttaagaaagctcactctgattactctgtagaaaattgattatagggtataagaggagaagcaagaaagactattgctctggagtaggcaagagatgatggtgaccctattaattagtagaagtagtgagaaaggtgtcagatttcagatacattttgaaggttaagggaggggtgcttgaagatcatgagagaatagactgatatattttagttgagtccactttggaatcacacaaaactatttttaattttgaatatactttagtgcccccagcattaattatgcagaacgttttaggctgtttaaaagcaaagcagataaattaaaaggaggttagtggttaaaacttctctttcctataaatctcaaagcaatcacaagacccctccaaacctcatatccctttttttttttttgctaatggttgtagatcacaccagtgttctacatttcatattctctcagaacttgctttgaccctcaatgtcgttctgttgtaatgataatgaaagttaaggtaacaaaaaccacttattgtttatcatgtgcaaagtattggtttaagtgcttttgctatattaaatccttttatcctcaaacaaccctattgtaacaaaaaccaagttcagtagcttgccactcacagagtccaattaacaagagcaaggtctggtataaagacagctactttttattccaaaggtagcttataggaagaagtataggcttcctgccttaagggtaccacttcccttttggagcagaaagagggtgcttttaaaggggttgcctggcacaccggcatgaatggcatgcaggggagaaagcaagcaggtggggagtcgatgtactagctttggtgctttatctactgggtagtcgagctggtgactgctggcgccttcttgggcaggcctaggttgtaaaaagcatcccaaaactctccagatgggagagagattcatagtgagcatgctttgggttgtagatggactgttgtctcttgaggcaacctcctgatgggtgagagttctgctctggagcttctaagtacatagttagatgaacttgccctgtaggaaatgtctggtaaagaggaagtaaaatagagctaagtaaaaagttggggaaaggagggaagagaaaagaagagagagagagaaaaaataattaaactatctcttggaaaattgggatacactatgaggtagctgctgtagctgttttacatgtgaggaaactactagtatatatgtactgtaagtggcattagataaactcagcacctaagcctactcagcatggcatattatattttatagtatcctctctactacttgtaaggggatagcgtttatgttatttcactaatcttttatatttttctgttttacatggtattgaaaaacggtaagcagaaggtttgagggaatagataatgctttaaaattttggcgtctgtaaatctaaccttttctcttatacttccaagtttgaatatcctgttgatttttttcttagaccacccaaatatcttgaaaattaccttgcttttgaacctaaacagtgtctctcagataacatttcacctctagaagttacacaaaaatctttcaacagataatgtcttgatttttgattgacagaatatggtcattgtattaccttatctttgtatcctcagtgcccacatagcacttggcacacagaaaatgcttagtgaatgtttactgaatgactgaatggagagaacagtttctctgtataatgtgatctcatttttacctactaaagaaagacaggtttgctttctaagatgggaaaatatgatcactgactgccccagattagacaccccagtggaaagagagaggttctatcttccagtattcatgtcaaccttattgaagaactctggcccttttgggggtcatgtgcctgctctttggaccaatcattactgccaaaaaaaatgagctattacaactggctaagcctaggtcaagttttccttttaatggccatggaggtatattgcattactgaaaggaaagctatgtggagcttgagcaaacaaagaatggcagctgtaattatccacaacaaaaattatatagaattaaaatttccaaacaagtctcaactcttgtttgcaattttatgaaaattataaatttatgaaaaagtgcaagttaaaaagaaaagaaacatggtatgtaaacatgggaaatgtacattttagtatttttgttaaggggaaagagaagcagaggtgaactctgtgaagtgattgaaaatagaaatcttaagggtaggcacctctcttttcaagtttccgtacagagattttaattcctttggtcaaaaggctgcaattcaagttgtttttgcaggcctggctcatttttccactgttttcctcatgggctcaaaggtctgttgaagtggtaaataaacgtgctttgaagctatcacaactcaccttgtgtagttgaacttgcttaggggcagttatcacagttcctagtaagccaagcttgtttctgacagctatggaggatgtgagaaagaacagaattggatagagaaccatttgggaaatgggagagatgtgagtgctgatatgctttcccctccatcgctaataaacttctagtgctattccttgttcttttaaatgtacctatagacattttgctctatgcaggaagtattccctaatgaaagaatggagtcagagcaaaaggaaacatctaagctttattgatctgtgcttatcttacattgctgctctctgctgagaaattgattgatttttttaaaaaaaaaacttcaggagcctttgttggatgttgccattgctgttgcaaaataggaaaacagttatgcataaattatctggagaaaatattttccttgatttttttttctttctaaaaatgtgtgggaagaaattatacaaagtgagtaaatggtggtattatttagaaaccattctattttcacttaggcaaccctaacattaagcaagaggatctttgtggagaatttactgttaatattgtttgcatatttacccaaacagcttgatataagggtttgtttttttgttgttgttgttcttaaattaccattttgagatctagaaatttttcccagcccaaataacaacaaaatcgtttactcattttaaaactttattgtttaaaaaaaccccactaacaaccctaaaatgaatgactccgtagttatttttaccttctttttatgaattccctcagctgaaattaggataatgttttgttttttccatcactattgaatactattcaattatcttttctttttttttttttgttttctttttcccaaatggctgttgaatttatttgcttgatcaataatggtcctggcaaaaattagttaaccaatgctgagacatttgtaatgaaatactaattttaaaaatccatgacaccttgatagaaattagagtttacacaaacaaaaaaggaaccttcgatattgccagcagctataaagtgaacgtactgagaccgacaggacagcaagaaggcatttgcacatttatatctgacacccgaccatactttcagtcaccagaatatcttctctccagatttaaaaaaatagtatgctgatttctataacaaagctttttttcgtacaaaaatcaaataatggccaacgagtcacaacagtgcaataggtagaggattaaaaactgcatcaaacaggtgctgaaaataaatactacctaggagaaggaggtgagagccctcgtgtggggtttgttttcgaccccttgagtgtgtgtggggtttgtcttccgagccacgagcctggcctgtctcgcggtgctgttcactctgacagagtgcgcctgcagcacgttgcctccagggcccagcctcccagaagcctcagagcatcagagcatccgtctcatcggatggacctcaattatcttttcatagaaatgatgtcattgttatacacatgcagtttctgtggcattggaatgagcgtgacaccataaaaataattcttaaagattgtcaatgtagtgttttctatatcattgtttatgagagttatggtttctgttgtttttcgtgcataaaaaatgcaatttttaagtatttttaaaaatcaaacatttgtaaaccataatctcctgcatattgttggtactgtaagtgctacttaggtaacagaaatgttataagtatttgataagatgcttctaaacattatacataagaacagtaggcatttaagataaacagaagtgtaaaatacatttaatcctaggccttgacttttttttttttttttttacattctggataatattatctactcccatgacatttcaagtggatttacttgtgtaaatgtgcacatgattcaaagcaccaaatatctgtttggtcttttcaataattcttcctgggtagctatcccttctgctaataacttcatctttcatcaagactaaaaataaacttttgagatatcgcccttaagtttttctctacttagactgtttctctttcacgctgttgccagattatctttctaaaggcaaaatcttggtcatatgacattcctgctgaaatatctccaacatcttatgttgtatagaggagaaattctaaactctagcatgaacttagaggccatcagcaatctgtccttagcctaattttactagtttcatagtttgcccagtgatcctcctctaaccaccatattattaagccacatttaactgcatgctgtttccacacctgcctttatgaatccatcttcacacgcactgtttgccctgagtatccttattttgccgctcaaatgtcccttgatttctctaggattctgcatccttataacactgtgcctagatcaccataacattaatacattacattacagttaattgttgaagtctttctcactagactagggaccctttaaaagcatgaactagccaatatttttgtaaatcccttatcctgtgcccattgtggggacttgacatgtggtaggtgacatgcctttatatattgtattgggtgcagttgcagggtttaaatactttttccctctgaaagaacttgtttgaactgtaaaagtgtctaaggaatatagtacctttttcccctatcacattcttccaaagtaggacctgttaaggatattctggtaatttagttgtgggtagggggaggtaaccttaaagtatgaaatataaaatcttgttataattcacttgacagtaaatatttaaaactaagttaaatagcccaagagagttatctatactaacacaagttaggaaagaatgaaaagatggttgttagaaacaaatgcttcgtgctgcaaagaagaatcagcactctggcaaaaagctttctcagcaaggcaattcacttctgaagaagggtgccactcatacctggtgtggtcacaagagcacaccgagcagggtatggcaggggtttttatccctaacaaagttcctagcacttctgtgtcctttccccattggctgggtttggacctcacaatctaagctaacttgattggctaaggtttaaaattgaatacagttaatttccatgtattaactttctagacaaccttgaacaggtccttgtacaattaaaagattgggtcagatcatctggcagatttcttattgggtagttacaaatgactagataaatagtagttccataaaatttaatttctaagataggacatttaatgaatttactgaagctgatattgggctataacttaaatggttttgactcagtgaaagttgagttaatgaaggaaaaagtcacctttcaggagcatttgctcccaggggtggcacattaaacagcattattgtgattatgatctttacctcttcccccaaactcccttacataaccaaaggtttcctcttaagtcttctttatttctctttaaatgtagaggtcatttagttctttaagggggaaaagacagtaatttgaaaacgttcaaatgccaacatttttttcacatttaaaatcagtaaaataattattcttagggcaagacaaaatgggtaaaaatgactcatatatatttgcaggactacgggagtcataataaagcaaaacatttttttctgtatgtccagtgttagatttataaaatcaaagtcatacaaagactgatgtttaagcacattaatcttctattataatgtttagacctctcttagcttggctttaattgtaaaatcacaggccttgaagagagaataattaactctattactgcagcaaccacttaaagatctaaatattttggagtgttctatttgaaaattagagggagaactagtcactacaaaaccatctacagatctttgtgttctttttattctttctcctcaacatgtagtttgttgcatttgtaagggagagaaataaaaatatgtttttgggcataaattttaagatttttaaagcctgttcttttcattctgtcttcttcagagtggtctgctgactgatgaggcaaaacatttgtacccttggacatatctcaaaataataagagctatctatgacaaacccacaaccaatatcatactgaatgggcaaaaactggaagcattccctttgaaaactggcacaagacaggggtgccctctctcaccactcctattcaacatagtgttggaagttctggccagggcaattaggcaggagaaggaaataaagggtattcaattaggaaaagaggaagtcaaattgtccctgtttgcagatgacatgatagtatatctagaaaacctcattgtctcagcccaaaatctccttaagctgataagcaacttcagcaaagtctcaggatacaaaatcaatgtacaaaaatcacaagcattcttatacaccaataacagagaaacagagagccaaatcatgagtgaactcccattcacaattgcttcaaagagaataaaatacctaggaatccaccttacaagggacatgaaggacctcttcaaggagaactacaaaccactgctcaatgaaataaaggaggatacaaagaaatggaagaacattccatgctcatgggtaggaagaatcaatatcgtgaaaatggccatactgcccaaggtaatttagagattcaatgccatccccatgaagctaccaatgactttcttcacagaattggaaaaaactactttaaagttcatatggaatcaaaaaaaagaccacgtcgccaagtcaatcctaagccaaaagaacaaagctggaggcatcacgttacctgacttcaaactatactacaaggctacagtgaccaaaacagcatggtactggtaccaaaacaaagatatagatcaatggaacagaacagagccctcagaaataatgccacctatctacaactatctgatctttgacaaacctgagaaaaacaagcaatggggaaaggattctctatttaataaatggtgttgggaaaactggctagccatatgtagaaagctgaaactggatcccttcctcacaccttatacaaaaattaattcaagatggattaaagacttaaacgttagacctaaaaccataaaaaccctagaagaaaacctaggcattaccattcaggacctaggcatgggcaaggacttcatgtctaaaacaccaaaagcaatgagcaacaaaagccaaaattgacaaatgggatctaattaaactaaagagcttctgcacagcaaaagaaactaccatcagagtgaacaggcagcctacaaaacaggagaaaatttttgcaacctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaccacttttacaccattggtgggactgtaaactagttgaacccttgtggaagtcagtgtggcggttcctcagggatctagaactagaaataccatttgacccagccatcccattactgggtatatacccaaaggactataaatcatgctgctataaagacacatgcacatgtatgtttattgcagcactattcaccatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaaagagatcacatggacacaggaaggggaacatcacactctgaggactgttgtggggtgtgggggagggggagggatagctttaggagatacacctaatgctaaatgatgagttaatgggtgcagcacaccagcatggcacatgtatacatatagtaactaacctgcacattgtgcacatgtaccctaaaacttaaagtataataataaaaaagaaaagcaacatttgtacccttgtagttttcttaaaccacaaatccaaattccaatcctagaatgtaactccaggatatgaaagatgggaaagaataatattacagtgtaaaatttgaagaaaactaagagaggaattttcatacttcactaaattctcacatctagtagttctgggtcagtgcccttattgcccttacctgacatttaaggcatatattgtgcatctttgtaagtaaatctgtgtggatacaatatagctttttgaatagatgttgattttggtttctgaataaaagtttctcttgtgatgaacctcacagtggcaaaatgtagatatgagaaggagaaaaccatttcttgagtaaaaatggtaaaaaaaaattttttttttgatctcacggcagcaaacttccaaaggcctttgatgtttgccattttgttgtgatagttaactaatctataatgtttgggactattgagttttgtgatttgacatttgttgtattggaatctgatctgtaaactagtagcatggcttgatgtagagctttgactaaagagactgagagaatgaagactaggaaatgaatttttactatctcttctcaaatgtttgtctaaaattagtcaagaacttcatttcattaaaaacgttaaagtttttttatttatatatgacctccaaaaatgattgaatattttttgaatacaaattctgtgccagtcagcacaccagctttttacatgattatctcatttaatccttaacacaacctcatggaatagatgttatcttcatttacagataaggaacattgggttcagagagagaagtattttgttcaagaccattttttcagctggtaaatacatgacagaggtaggactcaaaattcaggttttgtctgattccaaagcctgtgtgcttagtcactattataaaaacaaactcatagttcttgagtgagggaattatttaaggcttaagttacatttaccttttagtttaaaagacagtatatgtagtgactgtgtatcatgatgatccgtggtactgattattgaaatcattccacagaggtaggcatgtgcaggttgttgaattgtactattatagatcaattgtgcctggcactgttaacattttgaactgggtaattaatttgttctggaggactgtcctgtgtaccataggatgtttagcagcatctctggctacactcactagatgcgtataccactcccttgtgacaatgaaaaattgtcacgactttcagaaaaatcatcatccttctatctccaacagaagagtgaactcatgtttaacttcatgtaggtacagatgggatatttatcaatatgtatatagtacatagattaatagacacacatatttccttgttctgtcagctgacaaggtctagaagcagtgactgctcagtagcagtaagcagaccttacattcaaatcttggtttctaatattctccaacacaaggaaccaggactccttttagaaatggcagattctaggactgggttggaaaaaactacaagatgagcctggagcattttgtagtgccagaaactaaggaagttctcacaaaaaaaaaaaaaaaaaaaaaaaagacaaaaatcccccacaattataagagtatgccaaagggacacagaaactaacaggagagctctcaactgccaaatctggaataatttatgcaaaaaaaataaatagaatagtattgcattataacccaaagtataaaacaaatatccatgagcccatattgatataaataaatgatctcataaattaataaattgaagtgaagtagacaaatctcctgtgaggaattccaaataatttatgtaactacctgcccccaaggtgtgggacataactccccactccttaggtatgagctacccatagtgacttccttccaaagagcacaatcagtataggagagggaaaaataatgctccagtggagaaatctgatgaatactaccttagccaggtatttaaagttaacttcagcagtgataaatcatattgatagtgtgtgtatccttaacatgaagtaataagaatggcactttaccttactcgtcttcctctcaaaaacacataaccccagtctcatcgtgagaaaaacatgagacaaactacaattgaaggatattctacagaatacctgtttactactcctcaaaattttcaaggtcatcaaaaacaaggaaagtctaagaaactgtcacagataagggaagcctaaggaaatatgacaagtaaatgtaatgtggtattctggatgcgatcctggaaaaggggaaaaaaaactttaggtaaaaaattaggaaatttgaataaaatataaactttagtcaataatgtatcaatattggttcattaattgtgaaaaatataccatagtaatataatatattgataatagggggaattggtgtagtatatgggaactctatactatctttacgatttttctgtaaatctaaaacttttctaaaataaaagttttatttattttttttaaaaaggcctcaaaacattgccatatgtctctagggagcaaaatttcacctagttgagaaaatcaccattatagttaataccatagagaaaaaaagtatatttcatttttgtttctgttgagtccctagtggagaaataacattaatggaaatgcctaggatacctagtaggcacaaaggtgcaaagtacatatttacttaccttttctaatctctctccccttcccccttaaaattttagtgtccttgagggttttatatttttgtttttcttctcattctggtagctgtcttggattacctcatttgtgcctgtagcttcacatatcatccatatgttgatactaccaattcaaaatctttaggctgatcttagcttctaagtctagcttcagagtaagcatctatctatacttttatgtcccataacatgtcaaattcactagatttgagtcacaaaacctgatatctcctgcattctctgtcttgttccaccaactgaatatgtgggagtcatcctagattccctctaccttaaggcctgaattattgtaccctctttctctcactatgtcttccacatctatgggtttaaaacagaaatttgatcctcctaataccctttctcttaatcttataatggttcctcattgcatgtaagaaacttttttctccactgtcatgtacttcaatatctctaaaattgaccccttcctgttttgagcccctgaatctattttactggtttctgtggtaatacaaataacacaccactgacattgctgacctgtctccccttctactccacctaagctcctagagtgcaaagagtctatctttctgttcccatggtggttcatttatgatgactgaatgagtgaatgtggtttcagatttatggttatagattttattcagtgtgttcaacttgactggtttcctgtgttttgatatttctctgagtatggctttataaattcaatagtagtaatgagatgttttttatttatattagcagtggctttccattgaatattatgatttacctcatacttagttccttatatacattttaggagttgggaaaagcaaggtagttaaaatcatatcagaaaggaaccttactgttttttttgtgtctacatatagtacaataaaagcataattttagtatctttaatgtagatgtttgattagatattgaaacctttcaactataattagattaacagatctcctgctccatcctcattcccatttattagttgcttcctttcagactgtgatttaaagtttgagtgatgcgcctattctttctatagctaacagaattgttccaaagtgcagtgcagctgctactgaagctccttaggtcaatacatttttctgtaatagaaaaacatgtgtattgtgttttgtctccatagggatcttaaatctaatccatttaatttaaaataattttatttatctagaatgttacttaatattttgtataaaatatgcttattctaagaaaatgtttaagagttcttgtcagtgattattttaaaatgaaaacaggtaatgcaagaggcagctggacaatttttggatatatattgtctccaagttatatttcttcagaggaatgaataacaagtttgtttcccccgttactacgaactacacattatttttggagggaaataaaagggggtactgatgctttctgacatcaccctaattctctctatgaaaacagaaaccaaagcctcaagaatttgggctattaaaatgtaatatttgagctccagaaacctgttcttagaagtatgccgattgggatttatgtgaacttgggggtgggggaagaggggtggaaatgagatttcttaagaataattccattacttttgaggctgagacctagttcatagcttcaaagtatgattgggtttctcataattaattatctttttgctttcttgccccatgagggaagtctatagtaactactggatagaagtaattattgtaaaacatagttcaaagtcaaaatcttaatgactcctattaaatttctttttgatatgactttttatggaaatctgttaaatgtttgataattttcattatcccaaaataatgagactattatctgatatggcatactgtgtcagaggtcttcaagaccacttccaagtgtggtgatttgttaggataactcagagggctcagtgcatagtcctactaatagctttgatttatagcaacaaaaggaaaaggcaaatggtgcaaagaccaaggaatccaggctcaagctcccagtggagtcacacaggatgcccttaactcctccagtattgagttgtgacaacacatatgaaatgtcatatgccagggaagctcattagtgactcagtggccaggatttttatggaggcttgtcacatgggcagccttagcctagcacataccagatttccagactcccaaagaaaagtaaaccatattgtttgcacaatttaggcaaaatgagatattcttatcagggaatagtaggaactctcccaaaatccagaatcccaggggctagccaagggctaatcttgcaaggaagcttttctaaggatagcatctcagccctgttttattgtcttttcactgcatgtgcaatgtaacttgaatgcttataggtaaagtttgtctatcataattactgcagttttggaaggtggtcatacatccatgcctgtttgtgatggctaatatccatagtttgaaataaatataaacatggtcagttcagacttcaacacatcaagcatgttaacttttggaacagatgctatttttttttttaaatagaaataaaaaactgcatgttacaaaatgatcacaataggaatgaatatattgagactttttttttttagttcttcctgtgtaagttccataaatgtgtttaaattcagcaaacatttgagtgccactgtatgcctatttctgttctagatactagggacatagaaatgaatcaggcatgattcctgccatgaagaagcccatattctaagaaagatgacaggaatgtaaataaatatatgtttatagattagtataaggaacattattttgtcaaattgtattttttaagagattttaaaataagcttacttatactgctatttatgtgtcagtgtatattccacggacactgctatgtaatcttagggcttttttttaaaaaaaattttagtctcctgttttcttactttctttcttcttcttttttttatgagatggagtctcactctgtcacctaggctagagtacaatggtgcaatcagctcaccacaacttcggtctcctcagttcaagtgattctcctgactcagcctcccaagtagctgggattacaggcgtaagccaccacaagtggctaatttttatctttttagtagaggtggggtttcaccatgttggccagctggtctcgaactcctgacctcaggtgatccacccaccacagcctcccaaagtgctgggattacaggtgtgagccatcgcacctggcatagtgtcctgttttcttcaactctcttgatttttgtgctagagaaagtgagagagggcatgcttaattataaagtggtttatcacagtaagtcactgtgctggaacctatttaggctctccctacatcagccatcacaaacattttagtaactgcctttaagaaaaattttgccatagtgctattcattttttttttttttttgagacaaagtctcgctctatcacccaggctggagtgcagtggctcaatctcggctcactgcaacctccgcctcccgggttcaagcgattctcctgcctcagcctctgagtagctgggattacaggtgcccaccaccacactcagctaatttttatatttttagtagagacagggtttcaccatgttggccaggctggtcttgaacttctgacctcaagtgatccacctggctaggcctcccagagagctgggattacaggtgtgagccaccacgcctggccagttagtgctgtttttttttgttttttgttttttgtttttaagatggggacttgctctgtcgcccaggctggagtgtagtggcgtgatctcagctcactcagctctgccttccgggttcatgccattctcctgcctcagcctcctgagtaactgggactacaggtgcccgccaccacgcccagctaatttttgtgtgtttttagtagagacggggtttcaccatgttagccaggatggtctcgatctcctgacctcgtgatccacctgcctcggcctcccaaagtgctgggattataggtgtgagccactgcacccagccacagttagtgctattcttaatgtccagtacttgtagtagtcatattttgaattttatataaagctttatacaaaaagaaatcaattatcataatttcctgtttcccccatgcaatctgcctttttattcctgcctcttcttctgaaataactgaattattagtcagttttgctttctttcatttctccttttgatatgacttccttaatataatgagcttggaatttgctttaggtggttgttcagtttatcttctaatcatgtatcagagtcttctatcatgcccacagctccacaaaataactcaagaacctgagctctgggtgtggagctttactaactcttcttcccctttgctttaaatttttacactaacacgtgtattttttggtctgtcgtatatttatttatttcttttttgagacagggtctcactctgtcacccaggcaagtgcagtggcacgatctctattcactgcaacctctgactcccagtttcaagtgagtcttatgcctcaggctcccaagtagctgggattacaggcctgcgccacatgcccagctaatttttgtatttttagtggagatgggatttcaccatgttggccaggctggccttgaactcctggcctcaagtgacctgcctgcctcaatctcccaaagtgctatgattacaggcatgagccattgcacctggcctgtcatatacttttttataattattcatgtgcttatctttgtcttctgtcctctcagacgctgtgcttttttaccacaatttatacaaccagctgtgtgactttgggtaagttacttaacctcttaatacctctggctactcacctataaaacagagataataatactcacctcacagggaccttgtaaggattgcattaatatatgtaaatatcttagaatgatgtctccagcccacttgataaatgttatcttccccaactttttttaaaaattcaaaccttcaaaaatggtaagagtgaataagtatccacataccctttgcttgaactaattttttactttatgccaaattttccttatttctgtaagtgtgtgtgtaatttttttaaacgaaactacttgaaggtaaactgcatatattatgatacttcagcacatatctactaagagtaaggacattttcctatacaagcacacccaggaaatgtaagaaagagacaatgaaagtatttactatgcagtctgatatggtttggctgtgtccccagcaaaatctcatcttgaaatgtaactactacaattcccatgtgttgtgggaggaaattgaatcatgggagtggttctttcccatgttcttctcatgatagtgaataagtctcacgagatctgatggttttataaggggaagtttccctgcacaagctctcttttcttttctgccaccatgtgagacgtgcctttcaccttccgccgtgactgtgaggcctccccagccacgtggaactgtaagttcattaaatctctttcttttgtaaattgcccagtctctggtatgtctttatcaggagcatcaaaatggactaatacagtaaattgatactggtagattggggcactgctgaaaagataaccaaaaatgtggaagtgacgttggaacttggtagaggctggaacagtttggagagctcagaagaagacaggaaaatctgggaaagtttgggactccctagagacttgttgaatggctttgaccgaaatgctggtaatgatatggacactgaaatataggctgaggtggtctcagatggaaatgaggaacttgttgggaactggagcaaaggtgactcttgttatgttttagcaaagagactggcagcattttgcccctgccctagagatttgtggtactttgaacttaagagaaatgatttagtgtatctggtggaagaaatctctaagtagtaaagcattcaaggggtgacttgggtgctattaaaggcaatcagttttaaaagggaaacagaacataaaagtttggaaaatttgcagcctgacaatgtgatagaaaagaaaatcccattttctgaggagaaattcaagccagcagcagaaatttgcataagtaacgaggagccaaatgttaatccccaagtcagtggggaaaatgtctctagggcatgtcagagaccattgcggcagccccttccatcacaggcctggagaccgaggaggaaaaaattgttcagtgggctgggccgggatccctctgctgtgtgcagtctagggacttggtgccctgtgtcccagccactccagctgtgactaaaaggggccaaggtacagctcgggccatggcttcagaggttgcaggccctaagctctggcagtttccatgtggtgttgagcctgcaggtgcatagaagtcaagaattgagatttggaaacctctgcctagatttcagaggatttatggaaatgcttggatgtccaggcagaagtttgctgcggggatggggcactcatggagaacctttgctaaggcagtgccaaagcaaaatgtggggtgggtatgcccacagagagtccccactggggtgctgcctcgtggagatgtgagaagagggccaccatcctccagaccccagaatggtagatccacagacagcttgcaccagaaaagctgcagacactcaacaccagcccatgaaaacagccaggaaggaggctgtaccctgcaaagccacagggacagagctgcccaagaccatgggaacccacctctggcatcagcatgacctggatgtgagacatggagtctaaggggataattttggagctttaagatttgactgccctactagatttcggacttgcatggggtctttagcccctttgtttagccaatttctcccatttggaatgggtgtatttatccaatgcctgtatccccattgtgtctaggaagttactaacttgcttttgattttgcaggctcataggcagaagggacttgccttgtctcagttgagacatttgactgaacttttgagttaatgctgaaatgagttaagactttggggaactgttagaagacatgattggttttgaaatgtgaagagatgagatttgggagggaccctgggcagaatgatatggtttggctgtgttcccacccaaatctcatcttgaattgtaactgctacaattcccacatgttgtgggagagaccccaggggaggaaattgaatcatgggggtgggtctttcccatgctattttcatgatagtgagtaagtcttatgagatccgatggttttataaaggggagttttcttgcacaagctctcttctcttgtctgccactgtgtgagacatgcctttcaccttccaccatgattgtgaggccttcccagccatgtggaactgtgagtccattaaacctctttcttttgttaaattgtccagtctcaggttatgtctttatcagcaacatgaaaacggactaatacacaggctgtgttcacaatttcccaattgttcctaaaatttcctttatagctttttcctttttttattctttctctctctgtttaaaaacgtctaggaactaaacaagaatcacatttgctttagttgtcctgactcttcagtctgttaatttagaccagtcttccttccttttttcctgtcttcttgtgactttgacattttagaagactatagggcagtagcttgctttgtaacatgttcttttgaaaactgcacatactgattgaaagataacagactttgttaaattatatttcctctctgtggtcttcattgaactaaataattaaatgatagtaaaagtagccttcatttaatagttaaattatttaactattatatgaaataatttaactattaaatgaaggctacattttattatttaattatttaataactaatgtggtttaattaattaaactttaaagtttttagaagataaataaataatggagataatttgggttatgtgaaagatcattaaaaataaaatacatattggccaggtatgtaatcccagaacttcgggaggctgaggcaggcagatcacgaggtcaggagattgagaccatcctggccaacatggtgaaaccccgtctctagtaaaagtacaaaaattagctggatgtggtggcgcatgcctgtaatccaagttactcaggaggctgaggcaggagaatcgcttgaacttgggaggcggagattgcagtgagccaagattgcaccactgcactctagcctggtgacagagtgagactccatctcaaaaaaacaaaacaaaacaaaacaaacatattttgagtagaatattccaaaagattaggtttataaagaaaaaaattagaccaaaaaagttgttttatttgaaaaaggctttaaaaatatttcagtctcattttattaattctttaatatttattgagctcttgctaagttgttcctgttctcctaatgtttgaaatccagggagtgaggcaagctgttaggaaagtgtagtacagtgtgataaggcatgtgggtatatgtgatgaggagcttacagagtcctaggggagcaaataagaagggcagctaacttagaactgggagattagagagacctctccaaagatatagtatctgtgtatagacatattaatgtaggtataaaggtattatgagacaaccagacaaggggttaggggaagagtgttccagagaaaaggaacatcacatcccaagctctacgtatgagagagagagaacctaatatttgaggaatgtcagaatgacggtgggtatgcagtatggagaaggaactacagggtggcaggagaagaggctgaaagggaatgctggaggtcttataaaccacattaagggatttgaaggctactcttagctcaattggaaggttacctacaaaagtagaagtatgatataagcagatttgtactttaggaaaattggaaaacaaagctggtggcagggagtccagttaggaagctgttggctcaatcaggctaaagatgttggtgacccggattaaggtagtagtcattgaaatggagagaactgaatgagtttgagaaatatttgggagatggtatcaacagtatttggtgattgaagaagaggtataacatattaattaagaaaaagactgtagagcccagacatctgggttcaagtcctaagtctgtcacttagtagctttgtaaatttgggtcagttattaaacctccctatgcctcattctccccatctgtaaaatgggaagaaaaacagtactcattttataggattattgtgagaactaaaagaattaatatatgtacagaatttagaacaggtgccaggtacatagtaagtatcatataagtgttctataatagttattgttgcaattgttaatattattattactgatttgatatgtcagtgagggggagaaaaagagccaaggctaactcctagatttttaaaatggcagttgaggtgaattgtggcagattttatgtgtgtggcgggggcgggcagggaggaggtctgatgcattcacatttggatttgctgagtttgagaggcttttccagttggcatcgctcaataggcacatgaatttggaagtagggagaaagagttgaggatatcagtttgaaaattactagaatataggtgataattaagctgtggaaatagaatgaattcacccaaatgaagaactagttaaatagggagaaaggcatataaaagattgtgttatctttaagaatttattatttaggccagaagccaaagtataaaacttggtgccaaatggaaagtttagaaaactttcagcattcaatacaacttcatttaaattaggttggtcttcagaggatattgaggtgagtaaaatgggcagctagatgaaagaaaatcattcatctattgaggaaactgcagagaagtcactttgctaacacagggaagatgttgctgattattttctgttttggatctgacttaaggaaaaaagataaaagattcattcttaattggcagaatagcaaagaatgagttaagtctttctataaattatttgtcttaagtacctattgctagaattagttaatattgtatttactaaggaattctatattttttcaactattatgaaaattttcaagcatacagaaaattagaaagaacaggacaatgaatacccatataaccaccacttagattccatacccacctatctataagtatgtgtgtgtatgcgtacatgtctgtgtttagtgaaaccatttcaaagtaaattgcaaattttatgacactttaatcctaaaatatttagcatgtattccatattatacctcacaacaccactatcacatctaagaaaattgacagtaatatcttaatattagctactatccagtttatagtcaaattttcccagttatcacaaaaatattttttatggcttttttttcccttcctaaacaggatccaactgaagttgacatattgcctttaggtgttatacctctttagtctcttttgtttgaaaatcttcacctcccccaaccttttttttttttttttgaaaggaggagactttttaagagagcagaatgttctaaattctaaatttgtctgattgcttcttcatggtatcatttgtcttgttcatctatcctttgtaattcctataaactggaatgtaaaccaagttgattctattcagattaaatgttttggcaaaaatacttcatagatgacactgtaaacttcatattgtattgcatcaaatggctatcagattagcaataataagtttgatcttttctgtgtaataaaatacttttctcctttgagattagcaggaaattggtgggaataatttcatactaaatggcttagcatttattgatgactgaatcagttatttcatcgggagttgctaattctatcgttccttgtacattgttagctggcattcttaggtaaataagaattttgcacctggaaatgaacaacataattacttatttgctttatcctacagtacacaaaaataggtttaaaatgacaaaacccagtgttaatactataagcataatgtgaggttcaatatttttaatagtttttattgtccttagaatatatgccaataagaatgtaagtcagaatactatgttcaaaagtgacttgaaatattttttgttctcatgtggttatgttactgatttgacaagcaattaagttcatttgtttctacttgttttcggtcaaagtttgcttatttagatcttatatttagttttattctcttgaatttataaaacttttgttggttcagaagtcacactatattataaagtatagttggagaagtttggcttttattttgtacatctaccctctacctctgtccttttaccaccctgtcataggtaaacatttttattcatttctagtttagcctcctagtgtgtttctatgtgttgtgatataactgtgtaactgtccttgttaattagcgttgctataatgaaaattccataaactgagtggttcaaacaacaaacatttatttctcacagttctggaggctgggaagtactaggttgaaggtgccagcagatttgatgcctgatgagggctcaattcctagttcaaagatgtccatctttttgctgtgtccttatgaggcagaaggttaaggagctctctgggttctcttttattggacgctgttcccattgatgcaggctctgtcctcatgatctaatcacctatcaaaggccccacctcctcataccattacactgggggttaggtgtcagcatatgattttgggggaacataaatatttagtctgtggcagtactacaactctaactatccttattttttcttctatactggatgtatcatcttgtactccatagaggcatgcctagtatatttgatgcctaaagcagataactttttaatatatatctctcctatatgacaaaattattttcaaaaataaccatgaaataaaacaaaatataataatgggtagaaatgagatataaacattatattttattttattgaatgatgaatatataatcatgccaataaaaataaattaaaaataaaataaatattacagtacagaaaatgtttattaaaatattttcaccagaaaattcatcttaagtttttctatttgtttttttaaaaaacttctgaaagtttttctttttctggaaaatgcagagaaaatgactgtgtgatagtgggcattgatgctatttgacccactagtttataactgtgcattcaaataaacagtgccatttggtttcttctagtaatgtaaaagcagcatcttttgttgtttcccttagcattcttcacatttttgttcttttctcaatataaatgtccatttcctcacattttatttttgagtaatgaccatagccacagtttctatgtactgttctttaaataacagttttaaagctttatgttttattgtccattgttgaaagttgattccggctgtctgcaaacatttttgtgtctgattagctcatctaaaacttcctaccagaaaggaaaaaaaaaaaaaagacaacttaacgcaggaacagaaaaccgaatgttgtatgttctcctaagtgggagctaaacaagaatacatggacacaaacgggaacaacagacaccagggcctatttgagggtagagggtgggaggagggagaggattaaaaaaaatacctgttgggcactatgcttattacctgggtgaccaaataatttgtacaccaagcccccatgacacgcacttatataacaatactgcacatgtacccagaaacctaaaataaaagttaaaaaaaaaaaagacaacttagaaaagagaaacaaggccaggtgcagcggccttatgcctgtaatcccagcactttcggaggctgaggcaggaggattgcttgagcccaggagttcaagaccagcctgggcaacatagtgaaaccctatctctaaaaaaatacaaaaataagccctggtggtgtgcacctgtagtcccagctactcgcgaagctgaggtgggaggattgcttgagcctagggggtcgaggctgccgtaagctgtgattgtactactgcactccagcctgggcagcagagcaagcccctgtctcaaaaaaagaaaaggaaaggaaagagaaaaagagaaacagcatacactgatcattatttatttggaatatattatttaaatgcagaaatatatggtgtcataggggctagagacataaactgtactcaaaggaaacttgaataattttgaaacattacaaaattaacttctgaataaatgtaactgagtccatgtgcatcagaggctaaactgtgagttctccactttctttttttttaagttaattttcatatataaatcagtgtttattgagaaataagtaataaaaatctgctaatttaaagcttacatacaggttattaaaacttaacagtcactggaacaattatttagaatttagaacacaaattctttttcagggagtatttttatcactgacattgtttagaattgctggcacttgatgataaaaagcagaataatttttagttaggtttaatttttaagttctctatgtagaatgcacccccttgttgtgggcctcaagggtgatctgcttctaccaccctacctttggtatgccactgtatccactagcaaagtatgagactatctgtttcttcccaacctcaccaacagagtgttgttgaatgtttcatcagtctgatggtgagaaatcatattgttttaattagcattcatcttatgagtgaaggcttttataagtttaaaggtcgtgcatttctttttctataaaatgcctagtcatttattttgccatttgttttggtggtagtttttccccgactctatgtttgaacataagtggtattgcggggggtgggggtcgggtggggggctggggcggggacagggtacctttctcgaaaccttagtactcaacatgatacacaacagaaatcaccatgtctccctttaaggtggcttatgcatactgcagccacactaaggaactaaaacaacttcatatgtatgagcctaggaaactgttgaagtagagcttttcaaattggactcacagtttcatctgtttttatacattggaatttcttacacagtttcttttaagatataattcagttcttaagtctctgaatcactgctataaagtgagaacaaacatcagtggttcttttaaattttataatataccataatacaataagagctacataattagaaattagtaatttaaccaataaaatcagttaaattggtttcttcactgaattgagttaggcaatttaattaaaataattatcacataaatatagccctactgcttaaagactatttatactttgctaagaaagaaaaattgtatattcattttatagagtcaaatatgaatgtttgtattgcagttattaaacttttatattatatataaacagcttcccagaaacagaattgaacatgaaattttatctccatgtctgcaaattccctttcagtcagtatttatatatatattatctttgtctttatagtgttacctgcatgtttgtattggaccttttctacttttttttttaagttgtaaaaatggtaacaacatttaagacaaaagtgtaaagacagagcatagccactcataatcttatcactaacagctttttaattgtcagttgtcttattttttaatgtctcttctaaattgtcacatctgtttctttaaaaatcctgatctctaagaataatttctcctcagtggcactttttgcctactggtccctcttttaaatacgatagtattcttcaatagcaacaaaagtgtatttggttttaattttgaatttaaaatttaacaaagtatctcgtgtttactgaggttaaggtacttgtgaattatttattagagagcttggaaatgttaattttaagtgtatgtattgtaaatctgtctcatcatgtcaaaaacaaggtaatagaatcatgtaatatatgaagatgtatgttattaaagagctacaaagaattgatgttagtgcttacttgaacttacaacagactttttccaactgaattgagattaatttacatctctctagaaagcagtaacttctgacatccattcattttgaccatgaaaaataaggtggtgtgtggattgtacctctcccctgtatctattggtctcgttacctgtgtgccttgttttttctcatgtgacacctgtttattttttcatcacagtagctaaataacgtagtattagtatttgcctacagcagctctaagttatatggttttcttttagctttagtcatagacctccggattacttgtttcgtgtctctctgaagaaaaaaataaaagaaaatgtggtacatatacaccatggaatactatgcagccataaaatgaacaaaatcatgtcctttgcagcaacttcagtgcagctgtaggccattacattaaatcaattaacacaacaacagataaccaaatccacatgttttcatttataaatggtagctaaacattgagtacacatggatagaaagaggagagcaatagaccctggggtctccttcagggtggagggtgggaggagagtgagagtcaaaaaactacttattgggtagtatgctcactgtctgggtgacaagatcatttgtataccatactccagtgtcactcaatttacccatgtaacaaacctgcacgtgtatcccccgaacctaaagtaaaagttgaaaaataaagataaaaagatagatgaaatttagctatatatctattaatttaaaaccaccattaccaccacaactcagaaagaccttgttgccaagcgaacggaatacagataacacaccgtgtctttcatcacagagttttcatcttaatctcccttgatttggactgtttaaatatcttttctttttctttttttttttttttggaatcagattccccgtccccatagctaaagaatttaaatttgtctttatgatgctgttgtttttacctttttcttgggacacggtgaatattaatattctcatttcaatgtaatttctttttaatttttgagttttcttcaactgtgcttcttgtttattaaacatttagttcattctcttttctcctgcagggacacctataatttgaagtttgaatcacagcacttcccctgcacatctgtgagcattcattcacttcacgtctcagctaatttcttatgtttagtatgtttcttgactctgcctcctatttcaccaatacaattttctgctgcgctgattcttctaatgctgcttctactgccagtattaattggtttgtggctaaatttatcctgtgctgctgttagtgccctccaactgttctgcttttcccatagtccacattgttgccagaatgatccatctaaaatacaagtctggctatgtcatgcatcctggtaaaatatttagtgacttcaccacagagtaatgctctaatcctttaaggtcatgagttagatccttctttcatctgagcctcccgcctatcactctagtcatataatcccttgcggccttgcctttccttccatgccattcagcatgccctttctcctgcctggaatgcccactgtgctccctctatctatcctctccattcattcttccagtctatgttgcctggcttcccctaccagtcacaattattttctcttgggtacatactcctatgtaccttgtacatgcttcttaactggcttttgtagttatttgtttagactggtttatgatactataacactggggtgaccattatgacaccaaagacaggtattactttgtgatttttatatcccccatgcctagcatagtgcttggtattttgttttattacccttctgtcctcttcgttttatttattttaagggagaaagtaatgatcacctctatcatgtgatttttttttcttttttatgggaagtatttttattggaatcagactgtttaattgtttttctcctgtccatgttttcttgtacataatttactaatccctaagatgtggtcttaacagtaaattgccttaaatcaccatatggtattcagtcactgggtcagggtagaggaaccagttctgtaagtggcctgcaaaaggcccagttagtattcatttcagtaaccaaattacaggcttaagtcaaccaggactgacttctctagcttaattgtttggtctgaagcctgggatggtgctcagctttcacatgtgttcctagttatgcagctctgaaatttgaaagcaagctgtactcggccagggtggtcttattctcttgtttttattgtttgcctcaaagattatatttgctctaattcttaagcacttaaaagaataggggaaaaaacagaagctttatagatttctaaaaaatggtatacttttgttgttcgcttaaaaaaaaaacctctcaatagaaagttatgaagaggaggataaaaattcttcattgtcttgccactgagaaataagcacattttagaatatgttttgcatacacatataagaaacatgtaccaattttgtaaatattgtatactaaatgctattctgcaccttcctcttttttttaactcaatatatttaaacattataaatcagtagttgaagacacgtttcattattaatgatgtactcatcagttccctatagttggacacatttttttacatttgtatttgaatattaccttagtagatctttttctaagaggatatgcaagtatatgttaatagatattgccataatgcctttcagaaacgttgtgcaactgtatgccctcattaatagtgcatgaaaatacttattaccgcacatctctttcaaagctagattattgtcagttactctctgtgaggtaaagtcttccaatttccagccctaaattcagagctcttctctgaattccacatagttatatccaacaacctacttgatatttctacaaggtgtccgtctcaccaacatatcaaaacaacatgccccaatccaacctgatttcctgcctcaattctgaaacctgttcttctcctttctatttttctttaaatagaacttaaatttacctggtttctcaaatgagaaacctggagtcattattattttttgtctctgcctctctccctgaatcttcctgtcaaatgtaccaccaactattatggcttctacccacaatcccatgtatagccaaatacaagaagagcctgttcttaagctgtccacaattactagaagacatgtgtttttttttttttttaaaaaaatttgattagacagtatgaatctaactgttagggatataatcaaatttctacttctaatatttaatttaattatacatgtatttaaactcacaatttagagatacagggtttgccactgtgtcatacaaaaattttgttggtgctttttcaacactggaatgagtcatctaatacagttttccagatcatctcctcctcccttccatctaagttgtttgagataatgtattttttgaatctgtgtataatgctgtctcagttccaagtacaattagggcagaatttttccccctactttttctgttggcatatattcatgatcctgttacctaagcatggactgaattgcttttttcaaatgatcactgaaatattgcttgatggtgacatctaacacacacagcagggaggtaatacgtcatggaataattactaaatcttcttactttgcttacttttttctttttttttttaccagttgtgtcaaattatctcttgaagcaattgttgttggttccagctaacatgactgttccagagagtactttgtgatttttcagaacaaaataatttgtatgtcagtctgtaatctgaaatattctaaggttcaaatataagatgatttcctcttctaaggatagtttttgatattgaaaaactcttcatatatatgggtttgtacagtgaatctcaaatccatctccttttctccttcactaccactgtaaatcaaaatcatctcttacctggacagtggccctcactgtttaattgcaggccccatagctattcttgcccccctgtacattctccacacaaagttacttttttaatatgccagtctaattttcttacttctttacataaagcccattagtgctatttcttgactaccttttcagtttaccttggtacaacttggctcttaccattagcacatgaagtcttcagcttgatatagatagcagatagcctctatttagctattaaaatgcctgcattggtagtagtgggtaaggagggagctagagccgagggaacattttggtagctttatctccgtttctctatgaatttttgtcttttgctcctaggcattgggaatttttgctttccctgttgggagcaggcatggtggcttcatttggctccctctgcttcagggtgaactcatggtgaattagaaggtactctgccacagctcatacactttttgtcatgtactattccactctcaagttactgtcgtctgcagctttgaagtaggtttgcctactgacatcacacctcccagttaagaaccttgtacagaagaaaaatggccaatgagtttggccagtgagttccaccttcagtcctgccgtgctttctgatagctcacgtaaactggggatgtcagtggaggccttccggatattttctattcagagtttgcaaaacgtgctgtccttatgagctagagagttgcttgtcagcttttggcattccctcagtgtagtccaaattgttttgtattttctggagttgataacgtttttaagagataataaattttttctttcatttttgattattttttctcattttctgtgttgaaaagagggatttttgtaaaagtgacttatattgtcatgttgcctagaagactcttccagttcttgaacagacattttacattttgaaggatcattttaaaaaatattttaaatgtgttattgattaaagagagattagaaatggaaattggaaatacttaaattattttgtttgttgaatgtatgttgactctctctggactcagattacttttgatgtataatagaattttggggatctttaaccatttactgcagaaaagttctgagggtcagtatatatttttaaaagctatcagagaaaagaaaactattaaattgttcctttcatattggttaattatatcagcctactgcctgaatccagaggttgaaattgtttacaataatgaagtctcttaaaacacactatgaattctctaattatcatcttttttgggtcaatattccctttcagctgtctctttattagctgttgtaatgaaatatcagtaacagatcttccacctcaagtcttggacattctgttgaagtgcataactttgatttgtaaagactactaaacccagttattatgttttcagtgaaaatgacagtgcacaatagatggttttgtacgctcctgtcaaaaggatgaagcatataatatgactcagttattggtgtgccagccaggcattggttatctggcattacgacaggtttgctaatgattcctgatgtgagcgtcacaaagaaaaaattgtaaatagcctcaggataacacttctaaaatgctgggttttttttaagtactaaatgttcataatcccataaaaagtttagaaaagaaaaggacccaattttgattatttactttttcactttttctactctgttctgctaggaaggtcccatcttactttgcccttcctgatatatgaccttttaaggggaggttgtggtgattttgttgtgtcttgtctagaatgatgatttccatcttatttttcaaacataggttttagttctttagtttatccgttgactgagagtttcagttaaaagagaaatgattgcaatttatcctaggaatggtgaaaataatatttattttgaagacagctgaccaaagaaaagcctacacaaatagtctcagctttcatgtagaacttggaagttttttgtcataatggtccactatgttaggcctccttttccattaatgacatttaaagggcacaatttttcacaatttggtttccagtttgtaaaactttttttttcattatagtaacatattttcactgcagaaaatttgaaaaacaaaagctatgaagaaaaatgtttttaaagaaaaaagtttatttaaggccggatgtggtggctcactcctgtaatcccagcactttgggaggccagggcgggtggatcatgaggtcaagagatcgagaccatcctggccaacatggtgaaaccccatctctactaaaaatacaaaaattagctgggcgtggtggtgtgcgtctgtagtcccagctgctcgggaggctgaggcaggagaattgcttgaacccgggaggtggaggttgcagtgagccaagatcacgccactgcactccagcctggtgacagagagagactccgtctcagaaaaaaaaaaaaaagaaaaagcaaaaagtttatttaaaatgcttttcaaaatcacaaggtaattacatcctttgataataccttaagtattgttaagtatttaagaatgagtttgttttatgtgtgtcgcttacattttttttaattaattaatttattattattatactttaagttttagggtacatgtgcacaatgtgcaggttagttacatatgtatacatgtgccatgccggtgcgctgcacccactaactcgtcatctagcattaggtatttgcatatattcagttatgtttaatttggattcataccaaatattttattttgtaacttgctttttttcatttaaaatatatcatgagcattggactgcattgtcatatattgaagcattacttttttttttttttttgagataggatctcattctgttccccatgctggagtgcagtggtgcgatcatggctcactgtagcttcgacctccctggcttaggtgatcctccctcttcaacctcccaggtagctaagactataggtgtgcaccacaacgcccagctaattttttgtatttttaaaatacagacagcattttacccatctctacaaaaaatagagatggtctcggactcctgggcttaagcgatccacccatctcagcttctcaaaagtgctggaattacaggtgtgagccaccatacctggccaaaacattacttttaatgatgttgcttagtgaaagggtttgtgtgtctttgaagtctacagtaaaagtatttttctaatatgaatttattggaaacactatcagtataacaatcacattatttaaaatgtcatttttgcacgtttaagacaagcgtttatttagcactatgctagatattttggaggatacagagacacacaaaacataatttctgacttcacacatgcttaagatccagtgagggaagcagacacgtacccactgttctgtggcaagaaccaatggggaggagagatgaaaagatgaccttcttagtgtggactccagagttctgcccacgtcttgttttcagagcaggtggacaagcggtcaatgtgcaggtcttttgctttaaccttatttatgtgtacacagcactgtagatttatgtgtacacagcactgtagagcactagttagagtagacacaaaactgaaaccactagataaaacaattgggtgtggaggttagaagggtagagctgggtgttgacagactggtgtagttgcctcagaagtgagaatatagatatagatgcaatagcattttcctctggggcaccacctctttttctttacatctcagatccctggccatgtgtctgacagttttttagagaaatgattgttatttgtaaatacatcatacacagaaacacttgcttttttaagcaaataaaaatcataaaaacaaaaaaaagtccacagcatgatgggttttagttatacataatttgaatataagggagcaattttgatgctgcattaatgtggaattctacatgtgataaacagtgttagacttttagaatatatatttttagtttggtagagctcatggattttccagatgtataggctgcttaagccaaagagttctttctctagctatgattataattcttctgattataaatgcattaaaaaataataaaggaaggatgaagtggaggaatgtaagaaataagaaggaaggggagagagaaaagaaaacctttctgggcatgtgtaaggaaaccagcaggcttgaccttcaaatgccagtgatatgtaggacccagggcaacagatgaaatctgaccaatacatttgtgatggccccttccaggaacctatggaaagtggacactcccattttaatgtttactattgccataattcgtaatatagacgaagaatgtgacctttgttagcaggagcctttcttgtgactgctgaggtggtggctctattatgtagaatataataacattgcttcattgctttagtctgtttcttcaaactgtaacttgaaaaactgactagttttaaaaatggaaatggctcaagagactccagagtatttaatgcttttcacacttgggactggagaggaatttaattatataaattattttaaaaatccattaagttcctgcttgcctgtaacgagcgtggcatacttagagaaatgtgtagatataaaccttctgagtttaaaaccttggatatattcttttaagtaggagacagactagaaataatgagaaagcatttgaacacagatgtggaatatagaggtgaccagaaagaatatgttgatagttgttagcttatgggaattgcaaagggttttagtgtcagacctgagttagtggatgttcttttaaattattgttacaaggttctgcgtaacctactggtctatggaactcttatctcagattgtgtggactcttcctcactttctaagagccagcaacactggatttctctcagttcctctaaccactgtgttcttccccagctcaagtaagtgctgtcgcatgtcttgtttcctctaccaacatttcccccactgccctttttgccttgctggctcctatttatctttcagatttcagctacaatggcacttagtgaagtcttcccataactcccagatttaggatctaagttgtaaattcccacaatactctgtacagtagtccccccctccttattcttgggggatatgtcccaagaccccccagtggatgccggaaaccatggattgtaccagatcctacatatactatgttttttgatctaataacccagacagctactaagatagctactgagtaactaatgtgtgggtagcatgtatggcatggatatagagatgatacagcaggacaaagggatgactcacatcccaggcgggatggaacaggacggtatgggagttgagttcattgcagcactcagaatggcatgcaatctaaaactcattaattgtttatgtctggaactttccatttaatactttcagaccaaggctgactgtgggtaactgaaaccgtggaagacaaaacgttagataaagaggaactcctgtacttctcttttataatgtttccacgtttgaaatttcttcttcaatgtttatcttccctgcaagactttaagttccctttgggctcactctcattcactgcgtttagccctaagtacctactcctcagaactcagaaatgactagactgtgtcatggaaaagtaggctgttatgaaacaggaaacctgtactctataagcttatgcaaaagaagaaattcatcaaaagggaccatgtctcttacacacacaggtacatacgcgtgtgcacacacacaaacacacagagaaagagagagggagagagagaaagaaacagggatattctaggacagcgcttacaatgtttacagtgtaggctctgaagacagattgactgtgttcacatcccaggtctgtcacttactagcagtgtaaccttggccaagttacttgacttctcaatactttagcttcttacctataaaatgggaataataataacacctacttcaaaggttatcatgaggagtgagttaaaacatatagcatatactataataaatataattaatatgtatataataatgataataattctaaaataacagccctagtcatcagtgtttccatttcttgttcttgtctcattcctatgcctcttccacagaaagaagtgtttttggcttttcctgctgtagacttgttatacccaatggtgccagaagataatcgattcaaatggttagcttagccttattttatatttcagtccagataccattttgtgaatatgttttaaaatgttaataaataaagaacaaaatttgatgaattgacatataaactataattaaaacctactttaaagactcatagagcttgctgctttaatgaagaattgaagaaattgatgaagaatttattttagtgttttgactgagccaaaataaaatcagtttcattgttgaagaaacacagtttaacataaacttgtagatagactattaaagagtgctgtatcagttaagtgagcactgtcttctaaaatttcatgtattcaaggatggagagggtcaaatgaatagttaaaaatacaaattaaggccaggcatggtggctcatgcctgtaatcccagccagcactttgggagtctgaggcaggcggatcacttgagctcaggagtttgacaccagtctgggcaacatgacaaaacactgtctctaccaaaaatacaaaaattaacctggcctggtggcgtgtgcctgtggtcccagctacttgggaggctgaggtgggaggattgctggagcccccgaggcggaggttgcagtgagccgagatcgcacctctgcattccagcctggttgacagagtgagaccccatctaaaaaaaaaaaaaaaaaaatttaaactgattaacttattctattttctaggtacacactaaatctataaaaactaaactaaatcaataaaaataaaccatggccttggcctttagatagctgacaatttaggtttaacaatgtatatggtatttttgaacagcttttgtgtcatagaatgaatatgttttactatgaaatgtatagatactgattatctagaaaagcattgtaaatacttttatttttacaaagaagtagacagtttgatttattattttttagggatccccttccttgagccagggagccagtctggcattaggctaatcttaccactttcatggaggcttcccttactgctatagatctcatgaggtagaagaagtaataagagggactgctattctgagtcctggtctaatggaaaaggactagtttgtaatattggttgtgtgttgatgtggttgtattgaacagtttattgggaaagtcaccaagttgtcttacagacatcattgtaaagaagagaactgaaacatggttatgcccatcctttgcctttaaggaaaacagatatttgcaagattatagcatctatggctgtgatttcaaggctagagagttctaaaagaaaaattattagaagaaattcttataggtgtacaaaatgccctgaacagctcaggtttcttaaaggatgtgcatgattaatagatgaaaggagcacataatcatcacacagttatacagtgctaagactttaagaaataaacatttaagaattttctcttcaaaggccaaaatttaaaaggaactaagatgcctcagagtgcacaaagagcttttaaggttgtgtttggagcaagagcaacaagagggaagagatagctcactgtctgaagaagatattcttaatgtctgtttacaggtaaaaatcagacctatacaattcttactttgcttctataatcttgcaatagcagaaatccttttcctatagtaaaaggtaaaacaaacaacctgaaacagaggaaattaaacaaacaaacaaaaaatatgagaagatggagtatcattcactttaaatgaatttaaattttcaatactgaaatgtattgcctcccaggagttgacggactcaggtataatcgtagggttattgtcacttttttttttttaacaaaatatagttttttgtttgtttgttttgttttgttttttttttacaaaatcactgagaatatggggtaaatacttggagacaagagagagacaaatgtcctagtttccaaaaaggaataaagtatattgcaaaaacccaagaccaattccctactttaaactgtggtaaaatttgaagagattgtaaaaaaatgaaatattgtgtttagaagagaatgggatgatcaccatgaatcaatatgaatttataagaataagacatgccaaaatgacctcattttttttttgctttatttttagttgtataattgctattggattagagaatagtaaagacatgttgtatcttgactttcgccaagtggttgacagtgtttccttaactatccttgtggaaacatgatgaaattagattgtaattagattgatttacagctgcttgcctggccattgccatgcccgcatgcccagcgtttagttaaataatagttactttatatactggttcctcacagagaactggtggtgaacattaatttgcatatattcagaaagtatggatttgtagttaacgagtttttttaaggatttgtatgttgaaacttgagttcctggatttattcatgattgaggtttctgttagggacttttttgcaaccaagctgtatttgtaagatatataaatctgtttttaatttacatatgtaaccttgacttataaattacttagaagccaaggcgtaatattagcatttagagcaaagtctggctatgttaagaatgctaacgttatgaagaatcttttctttgttcagtaacaactatagtaagctcacttggatgtttttcatacccttgaaatgtcattcctgtgaactatccctaaacaaaaggcagatgttcatatacaaattgataatacagatatattcagcagtgtctttctgagttaatgtgtctgttggccttctggtaatcccacagtcagctgcctgttcaagatatttacatattttttaaaaaaatacaaattccctggaatcatatcaaagagagaaccatatattttgttcacttaggaagttcttttggcagtccatgatggctgctacatccaatatattttttaattaattgttacttttagagaatgcaagtccatagttaacttattaaactttcataattgatatttctttgatgcttgtaatattttgtttctagcctcaaaaaagtgtgataacttttttgaatacttgcagatgtttacataaaatatcacatttatttatttgcttatttttgagacagagtcccactctgttgcccaggctgaagtgcagccgcacgatcttgtctcactgcgacctctgcctcccaggttcaagcgattctcctgcctcagcctctggagtatttgggattacaggcacataccaccacaccctgctaatttttgtatttttagtagagatggggtttaatcatgttggctaggctggtctcgatctcctgacctcaagtaatccaactgcctcggcctcccaaagtgctgggattacaggcatgagccaccgcacccagccaaaatatcacacttacaaaattgtccctcacacttttctttacaactgttcgtctcggtgttacatccagaatcccagtagaaatgaacggtgaaaaacagagtgcaattccagccttggcctctgagtcttaagatcttgtaggcccttaaaacaagaattgaggccaggcacagtggctcatgcctgtaatcctagcactttgggaggccgaggtgggcagatcatgaggtcaggagatcgaggccaacctggctaatacggtgaagccccgtctctactaaaaaacacaaaaaattagccaggcatggtggcgggcgcctgtagtcccaactactcgggaggctgaggcaggagaatggcgtgaacccaggaggcggaggttgcagtgagccaagattgtgccactgcactccaacctgggcgacagagtgagactccatctaaaaaaaaaaaaaaaaagcaagaattgagttgtttcaattattttgccttaagagacccattatgctgtaatttatgattttattgtggctttgtccttaattatatctaatttaatggttgttattttatagattaaaatgcaatctgagtttttagcattttatagttatctttgtacgttataccatatctgacagtaaagcttcaaatttaaaaaaaaaaggaaatcgtgagttaataaaacaaagtattgagtcagattgtctttttaaattattcatgtattatcttttatccaaattaagtctttttctgaaaatatgttgtatagcagatatttagatgtcggagcctacattatgttgtttttaagtgggggaaaaaacaatgatgcattctctgtccattcaaaaaccctaaccaaacttccccaaatatcacaaaacacctttagacaactatatagcgatctacgaaaacttttgtataacatttacaaaacatttgagacatctcttacctgattttaaaaatacttaatgaattcattatttggtatatttttgttcaataagtaatgagactatacagtattgattataaattagcattttattctatccggtgatgaatagtatactgtatgattctgtattatacatttaaaaaatgaaataatattatttttatctaaataaggcttgggttagtgggatccctaaatgcttaatagaaacaacctctgggaccagagattcttctgtgttcatcctggtaaatatctttcaggtttattaaaatcacaaaggctcccccttgctcagcatctatttttagcaagacaaaagaaggactttttagggtttgtgtttattagtttaggatctgaatatgtttgctgaacttttgacatacactgatttcctgcttatgttaacaccgtcttgcataggttatgttcatttatacatatgagaagagcaaaagagggagttagaaatgtaatattgtggaataatagttaaaaaaattagctgatcaatagtatttggtttatctaagcttgtcataagtgcgttgctctaaataaaagagtatactttaatcaactgttcttattcaataaaataatctattttgccttagcattgattttttctaattatctgaagccttgtctaatgaacaatggtttggactgtttggagtttcattttaagttcaacccttactataaattcattgctatcagatttctgcaatcctgttttttctgcttaatatttctttgagagcccttatatctctctatttatttcccattttccccacaaataatagaaaatttttgactttcttaattattcacattgtatctaggagtcaagcaagtggacagaaaatgcctgttcaatctagtgataggaagaggaccctaaggtagggccagtttggccttttcgaagatcagaaagatggccaagaataggtggagcagtgtttgacagtgggaagagtgaccaaattaggatcagggatggctggagccagaacatgtagggccttctagtccctgttcgggattttagattttgttgcaagtataagatatctgaggggaccctaaacagagtagtaattatcagatttatgttttaaatctcactctggcttctaagtggtgggcagcaggaaggagacaagaatgatgccgattagaaggctgggacagaattccagatgaggaatcagtggtggcttagattagggtggtggcaaatgaaatgaagaaaagtcaaatatgtcttggaagtagaaccgacaaaagttgctaatgtgttggatctggatgggtagaagtgaaaaggagaaatcaaggatgacttctagatttcgagattgttttgcaagttgatggtgccttctacaatagggaaaatgttggggaggaaacattgggggcagatggaattaaaagttctgttttggctatctgaaacttgaggtgcttatttgacttccaaatatatctgcaatatatatgcatcagtttgatgagtttagagcttggcagaggtagatcaaggatggatacatgatatgaatgtggaagttatcattatatagatagtatttaaagccatgggactaaatgaaattactctgaatatttttgtcaccttctctgacctgtaccttctccctcccttaccatgtaaaattattcccacattatattgcaggtacatattttaattatagtacctataaataatttggtgttcttttctttttagtaaaattctctgatttctttatcctgtttatagctaactggtttaagagtattcagttactagcttctatatttaagtgaacgtctaaaaattatgcatttattttctgttttttttttttgtctttgctccaggcaaagtcattaataaagatttgcggcattacctaagtcttcagtttcaaaaaggatcaattgaccacaaactgcagcaagtgatcagagataatctctacttgagaaccattccatgtaagtatgtgatggaataaaagaactgaagcagaaatgtcctttcttaactaattaaacatctacagatagtttgatggagtatttcacatgaaattgtgaagactaagttgggaacaagaatgaaacaaaaattggataagaagaaaaattttcaaagaacttgagaggttttgtttttaaaagtagaaaaatggaaaaactgggccgggtgcagtggctcacacctataatcccagcactttgggaggccgaggtgggtggacttgaggtcaggagttcaagaccagcctggccaacattgtgaaacctcatctctactaaaaataaaaaaattagccgagtgtggtggcgggcgcctataatcccagctacttgggagactgaggcaggagaatcgcttgaacccaggaagaggaggttgcagtgagccgagatcatgccactgcactccagcctgggtgacagagcgatactctgtctaaaaaaaaaaaaaaggccgggcgcggtggctcacacctgtaatcccagcactttgggaggccgaggcggacggatcactaggtcaggagatcgagaccatcttagctaacacggtgaaaccccgtctctactaaaaatacaaaaaaaaaaaaattagccgggtgcgtcgcaggcgcctgtaatcccagctactcaggaggctgaggcaggagaatagcgtgaacccgggaggcggagcttgcagtgagccgagatagcgccactgcagtccggcctgggtgaaagagcgagattccgtctcaaaaaaaaaaagtagaaagtagaaaaactggaagattctatattgtgagttttaaaaagtgatgactagaatttaagattatataatcccagcactttgggaggctgaggtgggcagatcacctgaggtcaggagtttgagactagcctggccaacatggtgaaaccccatctctactagaaatacaaaaattagccgagcatggtggcaggcgcctgtaatctcagctacttgggaggctgaggcaggagaatcgcttgaacctaggaggcggagattgcagtgagccgagatcatgccgttgcactccagcctgggcaacaagagcaagaccctcaactcaaaaaaaaaaaagaaaaaaacgaaaaaaaatatatatatatttttacatgttgttaactagattttattcctgtaaatcaatttgtaaagccttatgcagtaagaagactttttagctcccagtgccttgcataccaagaacaagtattttattagaactttattttaaaataattttaaaatctttcccttccccaacaagaaaaaaaaaaaagaagaagaagaaaaaggaaagggactctctcttacttggaataatttcttttttccctccctccgtggcttcttcccttcctcccttgactatgtagtggcaaagagctaagtaaaattgagttcaaaatctttactctagcatcttactggctactttacttgggcaagttacttaatgttcctgatcctcagaaactctctatatagaattagaataacaagacttacctcatatagctgttactaggatttaaaatgagagcatatatgtaaactgcttggcctagagaggcactcaagcagtgtttgtccccttcccccattctaactggatctcctccctctcatttcacctcgattcaatcagtttttaaagtgcacatttctcagcactataggaaagggaaaaaaatttaaaaataaagtggacatctgattcttgtccaaaatctatagtttatccttcaaagatttctactgacaaagttcagactccttagcatcgcataaaatattttttgtttttttaatctgcctccttatctatgatttcctcctacaaatctaccttgtagctgcagattgtaacttctgcctttatttcaatttgtatttgcctgatgtgtctttgtccatcttgttattcttaaagtctctgaatctctgttttacaaatagttctagactttactcagtagccagtgtgaaacttcttaaatttttattgatgtgatcaatatctttagcctcagttctgtcatggtttttatatttaccatatataagccttttgtatgaaaagcttttcactgtgtagtcattttatttgatctctttttaggaaggtttgtagggatcttttttttaatggttaccttgatacctttatataataatctttgttcctccctccctatttttttgcttctgtctctactatgagtaatattaaaattacttagtcatctcttctttttccttccttctctcccatcatctgacttgaagtaatatctttttattcctacgaaatataaggtaatcagtaaatgtatcccacactttgctgtgcttttctcattcttaccctactttttttgatagttgggctgttgttctacattggctaagcaaatagccattacattactgtactttcctcctttataattatcatttatcttttattctgtgggtaaatacatatttaatataaccaccaatccttatgttgttatttttcactaattgtagttgtctaaagctttttctttactcgttttcccagcaaaggctcacaggatcatcttaggagtttgtttgtggcctttatactttgatgtttgtttggatggatataaaatttttgactcattttctttccttgactatcttaaatatattagtcaactatctaactgtttttggcataaagcattgctcttaaagagtttggtagcaatctaattttcattcctttgtaagtaacttgatattttgcctgcatgggatgtctcatttttagtttcatagctctagagcttcctcttcccttgttaaaacaagataataaaaatatgtacttgtactttctaagataggtcttttttttatactgccctctgccactttcacttaagtttttcttttaattttattgttccagttttgcagtttcctcagtgtgaggtttttatcctagaagggagctaaaatttattttgtttcatttcacagggtccaagcagctgtagcccttttagatctcaacaggccctcttaacttacacaaaaattgaagtgtccaaagctccctctaggaacctagacgcaatgacacatcagtagcaggtagcatactgaagggtcacatgtgatctctaaatatcatactttcctaaaaagtttgaggtctccttggagatagttctgattctaggtctggtacaaggaaagtacaagatgagctttggagcatataagtgtatcagaaagtatatagtgcttaaaacattatagagacatatcagaaggacatagaagccacctagaaggggtgcttgatacttactccaaaaatctgaaacaatttgagcaacaacgttgaaaaaagagggcacttctattattgtcagatattgagctgtaggtggaacaggactatgatccttgagagaagaagaaaggagaccacacacagaggaatcctataatttcctcaactttctacttagaggcactttctggaccacagcacaaggagggagagtccaggcagagtacaatggactctgagttgaagggacagaaatctgagttcaagaagcctgaggtatctggaatttgcaggacagaatgtcacagaggagagggctatgaagaaaaagagctcaagcaatctgtaaaggcacccccttgactctgtggctgaatactaagctgagaatatgtaggaccagactcttcaaggttaaaccaaaaaatctctcggagttttaagtttaacaattcccagagcttacccaggggccaggagacatttgagttctaatcagcttggtggaagaatcccataagggtcctcccttactagcagggctaaaatagtcagataaagctcctctaggcctgctttaacaaagcttaattaagcaagaccccaaaggatcaagtgaatatgcatgcaacttaactgctagcaaaaaaggaagaaagaaggaaagaagtaaatcaacactctttaaagaaagatagtgtctgggctcagtggctcacgcctgtaatcccagcactttgggaggctgaggcaggcggatcatgaggttaagagattgagactatcctggcctacatggtgaaaccccatctctactaaaaatacaaaaattagctgggcgtggtggcgggtgcctgtagtcccagctacttgggaggctgaggcaggagaattgcttgaacctgggaagtggaggttgcagtgagccgagatcgtgccactgcactccagcctggtgacagagcgagactacgtctcaaacaaacaaacaaaaaaatagaaagacaacaaaatggaaacattgtgtaacaaaatattcagagtgtccagcatctaataaaaaattactagacctgcaaaaagcaggaaaatgtgacccataatcaaaagaaaagtcagctgatagaaaaaagaaacagaaatgacacatgatggcattactataccaggagttttagttattagaaatatgctcaaggatttaaagaacagtatcaacataatgaagagaaaaattatatataaatattcatatgtgtgtgtgtgtgtgtgtatgaatgaagtggaaccttaaaaattcactgaatggactcaacaggagattcaaaactggagaagaaaagatcagtgaacctgaacacgtagcaatataaactaatgaaactgaagcatagagaagaaaatgactgaaaaagtgaacttttttttttttgagcaaccagatgacaatggggaggggagagatttctacttctgcaatgaagtaccagtaccataactagtactagatttacccttttgtaataaagaactggaaattggacgaggaatatgtaacagctgttttcagacattgaaatacaggcagaacaggactatgatgcatttatatttacccatgacaaactatcaagccaaagtggaggaaggagaaaaaaaagaaatagtgactgaaatgtttccaaatttgatgaaaataataagtgcacagatctaagaagctcaatagatcccaagcagaagaaatgtgaagaaaaccatatcaaaggacatcataattagattataaaaaaccattgataaaaagaaaatgatgctgggcatgctggcatgtgcctgtaatctcaacacagcaggaagctgaggtgggaggatcacttgagcccagaagttcaaatccagcctaggcaacatggtgagaccccatctctaaataaagtgaaataaaataaaaatttttgaaaaagaaaatgcaaaatacagaaaaaaaagataaattacatgcaagggaacaaagaatgactgcagtatccacagaaacagtataagccagagtccatcaaataacatctttaacatgctgcaaggaaaaaaaaaaacgccaacctggatttctatgtacaacaaaaatatccttcaaaaatgaaagagaaataaagaattttcagacaaaaagtgaaagaagttttcagcagcagatatacactgtaagaaatattaaagattggacaaaatgcacaaacaacaaacgaaatgttaaaggaaattcttcaggtggaagagaaatgatatcagagcaatagaactgaaaggaaaatagacaactttataattacagttcaagatttcaacatccccttttagtaattaattttaaaattaagtaaaacatcagtaaggtaatagaaaacatgaacagtattttcaaccagcttggccgagttactatttattagaagatgccacccaacagcagcagaatacacatgctttcctagtgcagatgatacatttacaaatatagaccatattctgcaccacaaaacaagaactgatagatttaagaggatttagacttaaatcatatgaaacatgttatctagccatcatgaaattaaattagaaattattaacgatggtgggaggattgcttgaggccaggagtttgagaccagcctgggcaacataccaggaccccgtctctacaaaaaaaaatttttttaatgaggcaggcaaagtggcacatacctgtagtcctagctactcgagaggctgaggcaggaggatcccttgagcccaggagtttgaggctatagtgagctataatcatgtcaggaatgagaccctgtctcttaaaaaaaatagagaaagaaagaaattactaacagaaagatattcagaaattaataattaatagcacacttctaaataaactgtgagttgaataaatcacaaaggagattacaaaatattacacatatcaaccaacaaattgaaatgtatcaaacacaatatatgaaaatttgtaggttgtagctagagtagtatttaaatggaaacttacagtattaaatacttatattagaaaataatgaagatttcaaattagtgatctaaaattctaccttgagaatcttaaaaagaaggaggaaaatacttattttaagtagaaggaagaaaataataaaaagtagaaaccagtgcaatagaaaatagaaaaaaaccaatgaaatacaaagctcattctttgagatcaataaaagtgataaacctctagctagactgcttaggaagaaattaagcacaaattagtgctatccggaggccgggtgcagtggctcatgcctgtaatcccagtgctttgggaggctgaagcaggaggattgcttgagtccaggagtttgagacaagcctgggcaaatagtgagactctgtcactacaaaagaaaacaatatcaggaatgagagaggtgacatcactgaaaatcctatagatgttaagtgtgtaagtgtatgataaagattttttttttttttttttttttgagacagagtctcactctgtcacccaggtcctggaattcaatgatgtgattagagctcaacttccatttcttccatctcctgggctcaagttatcctcttgcctcaacttcctcagttactggaactacagatgtgtgccaccatgcccagctaatttttttttaattcttattagagacgacatcttgctatgttgcctaggctggtctcaaactcttgagctcaagcgatcctctggccttggcctcccaaagtgttggaattacagacgtgaggccccacacccggcctaataaggaatattctgaataactttatgccaataaactcaacaacttagatgaaatggacaaattctttagaagacaaaaactaccagtgctcactcatgaagaaataggtgagctgaaaaatcctctatctattaaagaaattgaattttagtttttaactttcctataaagaaaactttagcagagaggggtaggcaccatctctgctgtttggtcgactcagccattccagcctgcgggctttggagagtccaaaagtttcagacaagggagcgtccccccagcagcacaacatagtggctttgccagatcatgaccagactgctgctttaagcagcctggatcacttccttctcactgggcagggactcccagttgggcccttcagccatgcccactggcacatactatggacagagctctgatctctccctgggatggagtgccccagggaggggagggctgccacctgggttggatggatgactcaactgttccagcctgcaggctttggagagtccaagctgatgggcagaagtggttctccaccaggacacagctgttttgttgaggtgtggccagactgtttctttaagcgggactctgatccgctcctcatctcagctgatcctcccagctggctcttcacagccagggcctccagccaccacccatgttctatggaactgacagagctccaatttctccctgggacagagtgcctgaggggtgggcaagctgccaccttggccgtttgggctcgtcaacgggtccaacctgtaggccttggagagcccagaccaatagggagctgaagggatccccaacacaacacaacacaactcctttaccaaaaagcagccacactgatgccattcgtcctgactgggtgagacctccttactggagtatccagccacctcctacaggtacgttcgggctggcagtagttcagtacccacctgggacagagcttccagaggaagcagcaagctgccatccttgctgttttgcagacttcactggcaatacctccaggtacaggaagaaccaaggcaactagggtctggagcagacccccagcacgctccagcagccctgcagaagagtggccagactgttaaaagaaaaacaaacaaataaacagaaaacagcaacgaagaaaaaccacaaaaaccccatccaaagatcagcaacctcaaagatcaaaggtacataagcccacaatgatgagaaagaatcaatgcaaaaaaagctgaaaactcaaaaagctagggtaccccctctcctccaaatgaccacaacacttctccagcaaggtctcagaaccaggctaaggctgagatggctgaaatgagagaagtaggctttagaagatggttaataatgaacttcactgagctaaaggagcacattgtaacccaatgcaaagaagctaagaattatcatagaacagtacaggagctgacagccaaagccattttagagaggaacataaccccctgttatagctgaaaacacactacaagaacttctcaatgcaatcacaagtattcatagcagaataaaccaagcggggaaaagaacctaagagctggaagactggctttctgaattaagacaggcagacaagaataaagaaaaaagaatgaaaatgaatgaacaaaacctccgagaaatcagggattatataaagagaccaaatctacgactgactggggtacctgaaaatgatggggagaatggaaccaagttggaaaacatacttcaggatatcatcaaagagaacttccccaacctagcaagacaggccaagccaacattcaaattcaggaaatgcagagaaccccagtaagatactccatgagaaaatcatccccaagacaattcataatcagattctctaaggttgaaatgaaagaaaaaatgttaagcacagccagagagaaaggccaggtcacatacaaagggaagccaccagataaaaacagtggacctctcagcagaaaccctgcaagccagaagagattggggccagtagtcaacattaccaacccagaatttcatatctggccaaaccaagcttcataagcaaaggagaattaatatcctttacagacaagcaaatgctaagggaattcattactgctagacctgccttgcaaaagcaccttaaggaaacactaaatatgaaaaggaaaaagcatcattaccaaccactacaaaaatacactgtggtgcacagaccagtgacgttatgaagcagccaccataaacaagtctgcaaaataaccagctagcatcatgatgacaggatcaaatccacacataaccatgctatccttaaatataaatgggctaaatgccccaattaaaagacacagaatagcaagctgtataaagagtcaagatccatcaatatactgtcttcaagagacccatctcacatgcaaagacacacataggctcaaaataaagggatggaggaaaatttatcaagccaatggaaaaaagcaattctagtttcagacaaaatagacttcaaccaacagactttaaaatagactttaaactaacaaagatcagaaaagtcaaagaagggcattacataatggtaaagggttcaattcaacaataagagccaactaccctaaatatatatgctcccgatacaggagcacccagattcataaagttccttttttttgtttttttttgagagggagtctcactctgtcgcccaggctgaagtgcagtggtgcgatcttggctcactgcagcctccgcctcctggattcaagcaattctcctgcttcagcctcctgaatagctgggactataggtgcccaccaccacacttggctaattttttgtatttttttggtagagacagagtttcaccatgttggctgggctggtctcgaattcctgacctcaagtggtctactcatcttggcctgccaaagtcctgtgattacaggcatgagccactgtgcctggccataaagcaagttcttagggaccttcaaagagacttagactcccacacaataatcgtaggagactttaacacccactgacaatagtaggcagatcattgagacggaaaattaacaaagatattcaggacctgaattcagctctggatcaagaggacccgatagttatctacagaactctccaccccaaaacaacagaatatacattcttctcatcactgcatggcacttagtctaaaactgatcacataatcagaagtaaaacactcctcagcaaatgcaaaagaactgaaatcataacaatctctcagaccacagtgcaatcaaattagaaatcaagattaagaaattcactcaaaaattagttgagtatggtggcacactcctgtagtcctagctactcggggctgaggcaggagaatcgcttgaacctgggaggcagaggttgcagtgagctgagattgtgccactgcactcctgcctgagtcacagagcgagactccatcttaaaaaacaaacaaaaaaacaaaaacaaacaaaaaaaaccaaaaaaacaataaaacaaaaaaagaaaaaaggaaagaaagaaagaagttcacttaaaaccatacaactacatggaaattgaacaacctgctcttgcatgattcttgggtaaataatgaaattaagacagaaatcaagaagttctttgaaaccagtgagaacaaaaagacaacacatcagaatctctgagatacagctaaagcagtgttaagagggaaatttatagtactaaatgtccacatcaaaaggctagaaagatctcaagttaacaacctaacatcacaactaaaagaactagagaaccaagagcaaacaaaccccaaagctagaagaagacaagaaataaccaagatcagagctggactgaagcagacagagacatgaaaaacccttcaaaaaatcaacaaatctaggagctgggtttttgaaaaaaataataaaatagacttcaagctagattaataaacaagaaaagagagaagattcaaataaacacaatcagaaatgataagggggaataccaccactgaccccacagaaatacaaacaaccatcagaaaatactataaacacctctttgcaaataaactagaaaatctagaagaaaatggataaattcctggacatatacaccctgtcaaggctgaaccaggaagaaattgattccctgaagagaccaatagccagttctgaaattgaggcagtaataaatagcctaccaaccaaaaaaagcccaggaccagatggatttatagctgaattctaccagaggtacaaagaggagctggcaccatttcttctgaagctattccaaacaattgaaaaggagggactcctccctaaccattttatgaggccagcatcatcctgataccaaaacctggcagagatacaacaaaaaaagaaaacttcaggccagtatccctaatgaacatcaatgcaaaaaccctcagtaaaatactggcaaaccgaatccaacagcacatcaaaaaacttatccaccacaatcaagtcagctttatcccgaggatgcaaggctggttcaacatacacaaatcaataaacgtaattcaccacataaatagaactaaagacaaaaaccacgattatctcaatagatgcagaaaaggcctttgataaaatttaacaacccttcaggttaaaaattctcaataaactagatattgaagaaacatatctcaaaataataagagccatttatgacagacccacagccaatatcataccgaatgggcaaaagctggaaccattccccttgaaaaccagcacaagacaaggatgccctctttcaccactcctattcaatatagttttggaagttctgaccagggcgatcaagaaaaagaaagaaagaaagcatattcatataggaagaggaagtcaaactatccctgtttgccgatgacatgatctcctatatctagaaaattccaccgtttctgcccaaaagcttcttaaactgataggcaacttcagcaaaatctcagggtacaaaatcaatgtgcaaaaattgctagcattcctatatatcaacaacaggcaagctgagagccaaaatccagaatgaactcccattcacaattgccataaaaaagaataaaatacctagaaatacagctaacaagggaagtgaatgacctcttcaaggagaactacaaacgactgctcaaagaaatcagagatgatgatggctgagcatggtggctcacgcctgtaatcccagcactttgggaggccaaggcgggcagatcacgaggtcaggagatcgagaccatcctggctaacacggtgaaaccccgtctctaccaaaacaaaaaaattagccaggcatggtggcgggcgccaatagtcccagctactgaggaggctgaggcaggagaatggcatgaacctgggaggtggagcttgcaatgagctgagatcgtgccactgcactctagcctgggagaccgcgagactccatctcaaaaaaaaagaaatcagagatgatgacacaaacaaatggaaaaacattccatacttatgaataggaagaatcagtatcatcaaaatggccatactgcccaaagtaatttatagattcagtgctattcccattaaactaacattgacattcttcacagaattagaaaaaaactattttaaaattcatttggaacagaaaatcagatgttctcacttataattgagagctgaatgatgagaacacatggacacatggtggggaacaacacacactggggcctgttggagggttgcgggtgggaggaaggacagcatcagtaagaatagctaatgaatgctgggcttaatatgtaggtgataggatgatctgtgcagctaataccatggcacacgtttatgtaacaaacctgcacaacctgtgcatgtacccctgaacttaaaagttggaaaacagaaaactttaggcccaggtgatactggtaaattgttctgaatatttaagaaagaaataataccaattctacacaaactcttctagaaaatagtggagggaacatttcccaactcattctgtgttgtgaacatgattctgattctaaaatcagataaaaatattaaaagaaaatgttaggctaaaatttttcttgaatgtagactcaaaaattcttaacagtattttagcaagtcaatatatatagcaatatgtaaaaggataatacattatgatcaagtggagtttgtttcaggaatgccaagttggtataacatttgaaaattaatatagtaatattagaaaacaaaaaccaattaattttttcaatagatgcagaaaagttatttggcaaaattcaactcccatttatgacagaatctgtcagaaaactagtctgccatttattacccattgcctcttggctataaatctacttttttgcctgcttgtgatactgtaacatttgtctcctgtccattggcacagtgttaagctttcaatagcgagcacagaaaggatactggagaaagaagagagttcttttcctggttccagtgtgtctttttctttttgctcctgctatccaaaaagacacccagcaagtttcagcagtaccctagcagtcagcttccctgtgacaagttcagtggcacacctgcaggagacttccttacagcaagttcagcaacaccctgataggtgatttcatgagtaccagcagtgcaccagctgacttatagtttcctggtgagttctgtgacatcccatttggtcccccagttttcagcaacatcctctgagaaccagttttcctatgggtttctcgcaagtccagccaatgtcttagctggttttctattcacaaacctcactcaccaccataggtagcttgctggcgaatttcactgataccccatgcagtttcctgcctgttaaatccctgacccactaactgtgaactagctctgtcctcaggcaacccaggaaaattccccaccatccagtgggctgttaccataccctcttcaatgaggtctaaatcccagaccttgggagagtccctcccttccaagtttgttccttatttaaatattctccctcagctttagggtgatattctttagagtcctcgtttattcctacttagttaattccctgtaaacagttaacaattctgtatattaaactgtctctgttcagattgccatgtggtttctctctcttctctggatcttgatacagaattagtactagtagcgctcccaggagacagaacctctaagaagggatttcagaattggttttggttgtcttggctgatcttacgtggagtgccaagtttcttccaatgagaggtgggatgctgataattcatgagaagccatggcatcacaatttaattacagtatcacttatggttgattgtgaagaaatgacaaatgaacccagtaccttgagagcccaaatgactgctgcacttgactgttatggcagtagttatggctacgaacactgtagtttaggatagattctcctgtgtggcaagtgcttacagagagaaactggcaagataaaatcaaatggtttactattgttgttattattatgaactaataaaataagattttgttactatttttcaatgatctctacttgatacagatgtctgataatagaaaaacttaaggagacattggttgggcatgttggctcacacctgtagtcccagcactttgggaggctgaggcggaaggaactcttgaagccaggagttcaagatcagcctgggcaacatagcaagactgcacctctaaaacaaatgaatgaatggaagcattaacacaaaataaataccaaataaaaatcatttaaaatttgaaagataatcacatacgtatttagtatttgaatttttcatacctaaaattgtagttatttatttatttatttatttttgatttatttatttatttttgagacagagtcttgctctgttgcccaggctagagtacagtggcacgatctcagctcactgcaacctccacctcccaggttcaagtgattctcctgcctcagcctcctgagtagctgggattacaggtgtgcgccaccatgccctgcaaatttttgtatttttagtagagatggggtttcaccatgttggccaggctggtctcaaactcctgacctcaggtgatccgcccgcctcagcctcccaaagtgctgggattgcaggtgtgagccaccgagcccaaccctgaaatgaaattttaaagcacaaagtatcaattgttttatctgatggtcttgatctttgtttggtgataaatatgccagaaaaaaatgtatttcattttgcactgacattcatcaaattattaagaatgtatccaaaaacatcctcatatcgggcattacaaagtatgttgtttcatgtaatctcattttcttttttaattctgaaagcatttcgtctgcttctcctgattttgattttgccgttgaaatctattaaatatattgcttttatttcagattttagatccgtttcttatttcatgttggaatgttccacaacagcattcactttctctctttgcattttttctgttaaatatttacaaagcactgaagcttgtaacaaataatcagtgaaaaatgccagaaaatattattggatagtattcaaataacctaacatttagatttctgagcatggttaacagcattacacagagttgtgtgttgaaactgccaatttaaggacttacttagcctccaaacttgttatttcttggaactcaacttataggatttatatgaagtataatatacatatcatcttattagtattgttttatgtaagaaagacccaccactagcagatatggccatgagcacacacttgtgggaacagctgcaagtaagactgacttgagtgtattgtgactactactctcccacatgcttctgtcctggttcctggaaatatcaaccttaacctttgattctgcctttcagtgtttcctgctcttgctttcatttgatatcagctgatttcttcaagccagatgtctctatgtcaaattattaaactttagtttgtgcaggagaattagaactttttttgtcatttttcatatcaactgatttgttgtaaatttagagaaagcaaattaccctagaaactccagaaggaattcctacttagtaacataaatcaaccgcagctctcatatattgcaggtgggaatgcaaagacatctactttggaaaataatgtgatgttttcttatcaaattaaacatacacttaaccataatacctagtaatttcactcctaggtattaactcaacatacatttaaatatatgtctacccaaagtcatgtaagttaatagcagctttatttattatagcccaaatgtggaaacaacccaaatttccatcattggtgaatggataattaattttggtatattcatacagtagaataccaactgaataaaacaagacaaaagatcaatgaggaaacagaggacttgaacaatacaagaccaaatggacctaaccgacatacagaacatttcatccaataacagcagaatatacactcttatcaagcatgcatggaagattctctatgataaaccacattagaccacaaaacaagtcttaataaatttaagatttaaattatgcaaagtatcatctctgaccataatggaatgaaactaaaattaattagcagaaagaaaacaggaaaatttgcaaatacatggaaagtaaacagtgtgttcttaaacaaccagtggatcatgagagaatttaggaaatacctggagataaattttttaaaaagatacaacatactaaaacttatggaatatagtaaaagcagtactaagagggaagtttatagcagtaaacagattaaaagagaagaaaaatctcaagtcaccaacctaatcttataccttaaggaattagacaaataagaatgaactaaatccaaagtcagcacaaagaaggaaataataaagactagagcagagataaactgaatagaaaacattaaaaaaaaagaaaaaaatcaaccaaaccaggagttgtttttttttaaaaagaaaatcactaaaattgataaacccttacttagattaagaaaaaaagacttaaatttctaaaattaaaaatgaaaaaggagatattataactgatgtcacagaaatgaaaagaattataaagactgctgtagtgaaaagttagatgcccacaaattggatgatctagaagaaatggataaagttttagagatataaacctaccaagactgaatcataaagaaataaaaaatctgaaaagacctataatgagtgtggagattaaagcagtaatcaaaaacctcccaacaaagaaaagcccaggaccaggtgggtcccctggagaattctaccaaacagttaataccagtccttctcaaattcttccagtgaacggaagagaaagggacactctcaaactcatttaaactcattaccctgataacaaaaccagacaaagacacaataaaggagaactacaggccaatatccctgatggatatttgacacaaaaattctaaagaaaatactagcaaaccaaattatattgcacattaaaaaatcatacatcttgaccagctaaaatttatgcctggaatgcaaggatggttcaacatataagactcagtcaatatattatgccacattaacatctcaatacagaaaagcaaaattcagtaccctatcaggatttttaaaaatactcaacaaattaggagtagaaggaaactacctcaacataataaaagctaacattatgcttaacaggaaaagacagaaggcttttcctgtgagatcctgcaataaagcaaggatgcctggtcttgccattactattcaacatagtactggaaattctagccagagtaataagacagcaaaaagaaataaaaggcattcaacttagaaaagacttaaaagatctctctttgcagataacatcttaaatgtaaaaagaatttgaacaacatgggtgaatctcaaaagcattatgctaagtaaaagaagccagacaactactggaatcaaattaatgtatgattccatttgtattaaattatattaaaggcaaaactatactgacagtaggtcagtaactgcccagagtggaggactacaaagaggcccaaggaaactttgggggataatggtttccaaagttcacataattgtactattagaattagtgcattctattgtaggtaaattatttctttcataccatcaatatttagaaaatgaaagtttatgaaaatattacttaccatagcatataagttttttaaaaatacctagaaattaacctctaatgaaacgtaagtcctctatagtgtgaaattgagggatgctaaagaagatctaaatatgctgacagaaatttcttattcatgaattaaaggcagtatggcaaagataccagttctgctcaaattgacttgtagattcaatgtaattccataaaaatttcagcctttttagcctgtttatctgattctagaatgtatatggacaggctttgaatacaaaaagcaagataggtggacttgctatactatatatcaagatttattaggaaaatagaataattataacactgataatgataccagaatggtcagtagatagaaagcctagtagtaaacacccaagcttatatagacatttccatgaaagaagtgctgtggctgatcagaagggaaattaatgacttttaataaattattttgagtagtcatttggaaaaaaaggaaattagactggtacttctcaccagctcccccatccccaccatctgttttttgtgttaaagtcctaggtgtgaaaggcaaacctgtagtgctttttaaaaagaatatagaatatctccatagctttaggaaaggatttttttcaactagacacaaaaaccattagctgtaaaggaaaagatttatacatttgactacattaaaattaagagcttctgtcatcaaaatacaatttcttaaaaaggtgaaaaaatcagaatgtgacaagatactctctgttcctctacatttatttctgcagtacaaaaaagtttacatgtgattggcacatatgtagaaaatgacatgaatttaactcaggttatactagtttctatgccattttcctcagcaagctaatgttttttatcatcaaatagctacaagtaaataaaataaaagaacacaactgaatattgcagctgaggaagaatatggcagtgtatatgatacctatacacttcaatttatcctcttttctgtttgaccatgtgttctgttttaaaaatctttattgcactatttgccctatcttcattatttagtagcctaacactttcttatacccgtttctgtcaagccaccttttcttttcattcctttcattttcttaaaagaccagtattttatttactctgttatttttaattgggaatttaacatgtcttttaaactgtattaatattttaaattaggaccattatttattttgttagtgttctagttacaaagttgcaaaggttttgagaagtcaaccatgactctattttcttcataatctctcttattatgggtgcatgatttttcagaaagtactatttcaagaaaacatatttcacagaaatcccccatttgcaatacatatgtctgacaatggatcacagtacttcatcaatactaagacagttatttcacattttaacatctctacagttgggaagcatcttagaatagatgaaatctttcaattataattgccagggttttttctttcttagagataaaataatgatgcagtttagaaggggttggttacttagatttgatgatttactataatattcagaatataaagaattataaatcaattttattttattttttattatactttaagttctggaatacatgtgcagaatgtgcaggtttgttgcataggtatgcatgtgccatggtggtttgctgcacccatcaacctatcatctagattttaagcctcacatgcattaggtatttgtcctagtgctctttcaccccttgccccccacaccccgacagaccccagtgtgtgatgttgccctccctgtgtccatgtgttctcattgttcaactcccacttatgagtgagaacatgtggtgtttggttttctgttcctgtgttagtttgctgagaatgatggtttctagcttcacccatgtccttgcaaaggacatgaactcatccctttttatggctggatagtattccatggtgtccctgtgccacattttctttatccattctatcattgatgggcacttgggttggttccaagtctttgctattgtgaatagtgctgcaataaacatacatgtgcatgtgtctttatagtagaaggatttataatcttttgagtatatacccagtaatggaattgctgggtcaaatggtatttctagttctagatccttgaggaatcgccacagtgtcttccacaatggttgaactaatttacactcccactaacagtgtaaaaacgttcctatttctccacatcctctccagcatctgtcatttcctgactttttaataatcgccattctaactgatgtgagatggtgtcttgttgtggttttgatttgcatctctgtaatgaccagtgatgatgagctttttttcatatgtttgttggccacataaatgtcttcttttgagaagtgtctgttcatatccttcgcccaatttttgatggggtagtttgtttttttcatgtaaatttgtttaagttccttgtagattctggatatcatacctttgtcagatggatagaatgcaaaaattttctcccattctataggttgcctgttcactctgatgatagtttcttttgctgtgcagaagctctttagtttaattagataccatttgtcaattttggcttttgttgctattgtttttggtgttttagtcatgaagtctttgcccatgcctacgtcctgaatggtattgcctaggttttcttctagggtttttatggttttaggtcttacgtttaagtctttaatccatcttgaattaatttttgtgtaaggtgtaaggaaggagtccagtttcagttttctgcatatggctagccagttttcacaacaccatttattaaatagggaatcctttccccatttcttgtttttgtcaggtttgttgaagattagatggttatagatatgtggtgtcatgtctgaggcctctgttccattccattgttctatgtatcggttttggtaccaataccatattgttttggttactttacccttgtagtatagtttgaagacaggtggtgtgacgcctccagctttgttccttttgcttaggattgtcttggctatatgaggtctttttgtttccatatgaaatttaaagtagttttttctagttatgtgaagaaagttaatggtagcttgatggggatagcattgaatctataaattactttgggcagtgtggccattttcacaatatcggtttttcctattcatgagcatggaatgtttttccatttgtttgtgtcctctcgtatttccttgagcagtggtttgtagttctccttgaagaggtccttcatgtcccttgtaagttggattcctaggtattttattctctttgtagcaattgtgcatgggagttcactcatgatttggctctctgtttgcctatcattggtgtataggaatgcttgtgatttttgcacattgatttttgtatcctgagactttcctgaagttgcttatcagcttaaggagtttttgggctgagaagatggggttttctaaatatacaaccatgtcatctgcaaacagagaaaaattgacttcctctcttcctatttgaataccctttatttctttctcttgcctaattgccctggccagaacttccaatactacgttgaataggagtggtgagagaggggatccttttcttgtgccagttttcaaagagaatgcttccagcttttgtccattcagtatgatattggctgtgggtttgtcataaatagctcttattattttgagatatgttccatcaatgcccagtttattgagagtttttagcatgaaggtgtattgaatattattgaaggccttttctgcatctattgagataatcatgtggtttttgtcatttgttctgtttatgtgatggattatgtttattgatttgcatatgttgaaccagcgttgcatcccaggcatgaagccaactggatcgtggtggatgagcttttctatgtgctgctggattcagtttgccagtattttattgaggtttttcgcatcgatgttcattagggatattgacctgaaactttctttttttgttgtgttctgccaggttttggtatcaggatgatgctggactcataaaatgagttagggaggagtccctctttttctattgtttggaagagtttcaaaaggaatggtaccagctcctctttgtacctctggtagaatttggctgtgaatccctctgatcctgtgctttttttggttggtaggctattaattactgcctcaatttcagaacttgttactggtctattcaggagttcgacttcttcctggtttagtcttgggaggatgtatgtgtccaggaatttatccatttcttctagattttctagtttatttgtatagaggcatttatggtattctctgaaggtagtttgtatttctgtgggatcagtggtgatatcccctttatcattttttattgcatttatttgattcttctctcttttcttcttttttattctggctagttgcctgttttgttaatcttttcaaaaaaccagctcctggattcattgattttttggagggtgtttcatgtctctatcatcttcagttctgctttgatcttggttatttcttctgttctgctagctttttttttttgagacagagtctcactctgtcacccaggctggagtgcagtggcacaatctcggctcactgcaagctccgcctcctgggttcacaccattctcctgcctcagcctcccaagtagctgggactacaggtgcccgccactacaccctgctaattttttgtatttttagtagagacagggtttcaccgttttagccaggatggtctcgatctcctgacctcgtgatctgcctgcctcagcctcccaaagtgctgggattacaggcgtgagccattgcacccagccctgttcggctagcttttgaatttgtttgctcttgcttctctagttcttttaattgtgacattaggttgtctattttagatctttccagttttccgatgtgggcattcagtgctataagcttccgtctaaacactgctttagctgtgtcccagagattctggtacattttgtctttgttctcattggtttcaaagaacatctttatttcttccttaatttcgttatttacccagtagtcattcaggagcaggtttttcagtttctaagtagttgtgcagttttgggtgagtttcttaatcctgagttccaatttgattgcactgtggtccgagagagcgtttgttatgatttccgttcttttgcatttgctgaggagtgttttatttccaattatgtggttgattttagaataagtgtgatgtgctgagaagaatgtatattctgttgatttggggtgaatagttcagtagatgtctattaggtctgcttggtccagagctgagttcaaatcctaaatatccttgttaattttctgtcttgttgatttgcctaatattgacagtggggtgttatagtctcccactattattgtgtgggaatctaagtctctttgtaggtctctaagaacttgctttatgaatctgggtgctcctgtattgggtgcatacatatttgggatagttagctcttgttgcatggatccctttaccattatgtaatgcccttctttgtctcttttgatctttgttggtttaaagtctgttttatcagagactaagattgcaacccctgcctttttttttctttccatttgcttggtaaatattcctccatccatttattttgagcctgtgtgtgtctctttgcacatgagatgggtctcctgaatacagcacaccaaaaggtcttgactcctttatccaatttgccagtctgtgtcttttaattggggtattcagcccatttacatttaaggttaatattgttatgtattaattatatcctgtcatcatgatgctagctggttattttgcacattagtcgatgcagtttcttcatagggttgttggtctttatattttggtatgtctttgcagtggctggtaccaatttttcctttccatatttaatgcttccttcaggagtaaggcaggcctgttggtgacaaaatccctcagcatttgcttgtctgtaaaggattttatttctccctcacttctgaagcttagtttggatagatttgaaattctgggttgaaaatccttttctttaagaatgttgaatattggtcgcctactctcttctggcttgaagggtttctgcagagatctgctgtgagtctgatgggcttcctttgtaggtagtctgacctttctctctggctgcccttaacattttttccttcatttcaaccttagagaatctgacgatcatgtgtcttgtgattgcttttcccaaggagtatcttagtagtgttctctatatttcctgaatttgaaagttggcctctcttgctaggttgcggaggttctcctggataatatcctgaagtgtgttttccaacttggtcccattctccctgtcactttcaggtataccagtcaatcataggtttggccttttcacatagtctcatatttcttggaagctttgtttgttccttttcattcttttttctctaattttgtctttatgctttatttcattaagttgatcttcagtctctgatatccgttcttccacttgattgatttgcttattgatacttgtatatacttcatgaagttctcgtgctgtgtttttcagctccatcaggtcatttatgtttttctctaaactggttattctagttagcagttcctgtaaccttttatcaatgctcttagcttccttgcattgggttagaagatggtcctttagctcagaggagtttgttattacccacctcctgaagcctacttctgtcaattcatcaaactcattctctgtccagttttgtgcccttgtcagagaggagttgtgattatttggaggagaagaagcattctggtttttggaattttcagcatttttgtactggtttttcctcatctttgtggatttatctacctttgatctttgatgctgatggcctttggatggggtttttgggtgagcgtccttttggttaatgttcatgttattgctttctgtttgttagtttcccttctaatagtcaggcccctcttctgcaggtctgctggagtttgctagaggtccactccagaccctgtttgcctggtatcaccagcagaggctgcagaacagcaaagattgctgcctgctccttcctctggaaacttcctcccagaggggcacccacctgatgccagccagagctctcctgtatgaggtgtctgttgactcctactgggaggtgtctcccggtcagaaggcatgggggtcagggacccacttgaggaggcagtctgtcccttagcagagcttgagcagtgtgctgggagatctgctgctctcttcagagtcggcaggcaggaacatttaagttactgaagctgcacccacagctgccccttcccccaggtgctctgtcccagggagatgagagttttatctataagcccctgactggggctgctgcctttctttcagagatgccctgcccagtgaggaggaatctagagaggcagtctggccacagccgtttttctgcgctgcagtgagttccacacagtccgaacttcctggcggcttccttaacactgtgaggggaaaaccacctactcaagtctctgccatggtggatgcccctccccccaccaagctcgatcatcccaggtggacttcagactgctgtgctggcactgagaatttcaagccagtggttcttagcttgctgggctctgtgggagtgggacccactgaccaagaccacttggctccctggcttcagccccctttgcagggaagtgaacagttctgtctcactggagtacaaaaaaaaactcctgcagctagctcaatgtctgcccaaacagccgcctcgtttcgtgcttgaaacccagggccctggtggtgtaggcacacgagggaatttcctggtctgcaggttgcaaaagctgtgggaaaagcatagtatttgggccaggtagcacagtccctcatggcttcccttggttaggggagggagttccctggctccttgtgcttcctggatgaggcgctgccccaccctgcttctgctcaccctccgcgagctgcacccactgtctaaccagtcccaacgagattatctgggtacctcagttggaaatggagaaaccacccaccttctgtgttggtgttgctgggagctgcagaccagagcttttcctatttgggcatcttgccagctcccacaaatcaattttaaagacacaaacccaacagagaaatggggaaagacttgaataaccacttcacaacagaggaaatctatatggcttctaaatgtattaaaaagaatgtttaatctcataaagcaattgctttatgaggttgaagtgaagggtaaaatcttgagtagccctcctatttttcggatgtcttgttcattgttgaggttgtggatgatatatccggagcatatgaatagtatggctttaaagaaagtgtgggattaaataaacagtgaagtgactttacacacccaggatattggaaaaatcttataagcctcatgacaagtattggtgtggacagaagagaatgcatgttatgtgattccattcatacgaggttgcaaaagtggcaaaactaagctatgttgcttaaaaatgcattatttagttggtacaatcattaaaaaggaaaggaaatcatcacagatgtcaagatggtagtcacttttgaggatggagggagggagaggtttatcatcagagacacacaagaaggtttttgaggtcctggtaatgttctgctttttgcttgggttgatttgcttgtaactaaacagaaagggtaaatgatcagttatgtcaaatgttattcataggtcagttaagatgagggtaagacttggccattgagttcagcaaagtggagactattgttgaaacatagcacattgtctcagtgaatggttggggaaaagatcttatttgaataggctcaggagacagtgagaggagaattggagactgtgtatggctccaaagaactcttcggagcaatttttatgtataaaggagaaatgtggtgagaagtgggggtgaggggggatgtagaaagctttatataaaatatacagtattaggagaatataaagataaattttatggaatgcgaaaagtaatggggtgaaggaaggaagataactttatgtgtattgggttgtatggttttgtggggggagtgaaaatttataatactttgtaaagagaattaacattaaaactattttctagtcttagaaatatatggtagaattacacataccattcatatctgtccatgaaaagaatcatggacaacatcctgctcaacaccaccttgcagaaagagaaagccaaaagagattaagtagttgcctaaattgtgccgttaataataatcacagaccaaaacagagttcctcctgccctttcgatcagtgctgtttttatagtattatctataatatggcttgcttttaaattgttttttagtcattatgttttatagtggagtttatttggatatctcaattagcctttgctgtataacagactaccctaaaacttagtggcttaaaatagtgatgtttatttctcatgatttcatgagttgggctcagtcgggaccattcatgtggctataatcattgacagctcaactggagctggaggggctaagatggcctcattcatgtgtctggggccttgctgctttttgttggcttgggctctctttatcactcagtagtctagcctggacttccttgcatggtagcaggagcattccaagagggtgaatatggaagtctagatccctaaacttggacaacatcacagcctttacattaaattaatcaaagcatatcatcaatccagtccaaattcaagggatgaggcaacaggccccacctcttaggaggtgcagaatatcgtcatcatattttttccatctgtcatagataattacaaattataattttaatccttgaatttccttttttttttaagagacaggatctcactctgtcgtcaaggctggagtgcagtggtgctgcaatgataacccactgcatcactgcatccttcaactcctggtctcaaattatcttcccacctcagcctcacgagtggctaggactactggtgtgcatcactatacctggctaattttaaaaatttttttatagagacgaggtcttactatgttgcccaggcttgagttaatgtctaatgttaacttttatttaatatggagctaagaagctgttgattcagagaatctaacaatgtagttttggtcaataatgagaaatataaaaatttgaaaataaaaaacgtattaaaaattaaaggaaaaaagctgttttccagattttatatcctctatgatgtaaaacaggtaaagaaatgcttatttttagaaaaaaaaattgggttaaaaaatgggggagaaaattcaatatagtctttgttgcacagaatgttgacataatcattattttctcagattattaccattaatttgttatcataatctttgtttttttttgtgcatgttacagaatataatagaatgtaatgtgactaaaaacagtaggagcaattaagagtttcccatgaattaacttacagtaataataagagcatattgccaggcactgtcctaaatgcatttgtttacaatttcacttaatttatttgacagctatgtatattcagcacctactgtgatctttgcactgtgtcaagacttggggctattactctgaatcaaatcgacatggtttctgcatgttgccataccctagatagaaatcagggaaggttctctaaaggaactttctaagccaggacctgaaggatgagtagaagttagctgaggtgagagtgggaaagggagtaggaagtcctctggggacatgacaacgaccttgaaagtatgtgagtgaaaggaacattaaaataattgaaaaatatatgtagtatactaaagcctaatgtgaaaggaatgaggcaagaaagaatttggggaggttgccaggggccagatcacaaagggctttgtaaaatgtgttgttatagaatctggattttatgccaaggatcatgggaagccattgataggtttagagagagattttgtttgtttcctcagactgtgttttagaaaagtcactgactgcagtgactaggaggagtgtagctgggaagaagtaaaggttgacctaggggtaccaacaataaaggtcctagataatgatatgaattcagtgattatgggaatgaaaagaagtatttagaaatacttatgaggtagatttggtgactggatgtggagtagagggaagagcccaagacgactgactctcagatttcctacctggagtgctattactgaataggggcctaagtggaggaacaggtttgagaaggaaagtgttcttgtcctagacttgcaaccaattcccagtgaaaatcctgtatctctttgtattatctagtatttgaaatgacattgtgtaaaagtgactcttgtttagtaaaattcagtcaaatgtagcaatgctgccataacctgaatttacaccttgaagctgaaagattgtactttagcatttagtgatctgttactgtagttaattttatgaaacaatttacttactgcttaatttttaaaaattacttgaagagaataatggctaagaagccatatgtgaatacctatcttaagccttttattcacatataaagtaactttataaccagtgtttgtccaacttttaaaaataaagttcattaaaataacttataaaaaatattattttttgtctttcatgactctagtaagtagaatgtttacatttatgctagagatgaaaaaattaagtaggataactactttaaaataagtctgtctttcaccaggtgtgcacatgtatcaaaacatgttgtatgctataaatatatacaattttatctgtgaattttaccttaataaagttggggcaggggaatgaaacatctcttatgtgttctctacaaactgaatattcttttactttgaatattttgtaagtttaaaagtactttacaacctacttttttttttcttttttcttaggcactacaagggcccccagggatggagaagtaccaggagtggattataatttcatttccgttgaacagttcaaagcactggaagagagtggagcattgttagaaagtgggacatatgatggtatgtccccaaataacatcactaccacccaaaaaactatctgaacgactggaattatttcagagggaatttgaccagtaaagtaccactttttgaaaaactttttttcctctctgtttttgagaaaattttcttttgatggggagatttgtaatttattaattaaaatgggattaaataataagcaaaaaaaatccatcatattttaaagttgattgtgaacagtatactaaaaatcagccagactggccagtttatatatttcatagtaattcacattcatcatgtgaactcagtgagtatttgttgattgcattttatttgtggttggaattcaaaatctgtactttaaaaaacttacatgtaccttgactatcctggaaaaaagagaatataaaatttggggagaaaacaacaaaaacagaataattggttttcttttcatttctgtttcctctacccacttgattccattgatatttgatatttgagatcaatttccatttttaaatgactctgttagatctatttttccccttatgtaacatacccttccctggcaagcttatccacttccatagcaccctacgctatggtccattattgctttttcatactattataattgcctgtttataagctctgtgatagtaatggtcatgtctttcttacttgatattatcttcagtgcctaaagatagtgttcaataaatatctaacctggaattcagcgtatctaaatatgcatttgtgttctatccaaaagagaaattcttcatcatttctctctttagcagcaccatgatctcagaacagtgaaatcattatttactttctcctttttctcacatttcacatccatttgccaaatctcatcatttcttcttttgtagctgcattcacaatacccttctttcactttcaccacctcattgtaggcccactagaagagctcatgtgtggactattgctgttgatctcatttgttcccatttcttccaccctgcccattgctaccatgctagtcttcttcaagagcagctttatcatgtctctctcctattcagaactttcaatgatttcctttcatctgctaagtttaacctaactaccttttctgggcttagcgcccatgactcattcatttgttcattcgttttatcctgttttattcattaaacaaccatttattaagtacctactatgtgccaagtactaaaagagaatctcggaatactgtaatgaacaagattaaagtgcttttgaagtttttttttgtttgtttttgtttttttttaagaagccctctccccttaaatgatgaagatgctctacattttcttccactaaatataagagcttggtatggacgaagtggcatattacttattattaattgctgtgtgctcaattcaaagaaaatgcaaattaaaatagttgtacattatttcacatccatagattggcaacaattttacagtctgataattgcaagaaatggaaactcccatacactgctggcaagactataaaatggtataatccttctggagagcatcgtggcagtagctggtaaatttgaagatatacataactctgacctagcagtgcccctctctagacatctactcaggaaaaactgttgcccatatgcatatgtagacacatatgggaatatttgttatagtgtgaaacagtgacagaatggaaacaactctcctttagtagaatgaataacatacattttaatttgttcataaaaatggactgctatacagcagttcaatgtactggatttataggtatcaacattaataggtcttaagaggcataaaaagtataaaattatataaaggtataaaattgtataaaaagaaagttacaaaaggatatgtacattatactatttatgaaaaaatatgtgaaatattgtgaaaatactctgtgaagcttttatgaaaacaatagtatttacatgttatagatgcatatatacatatcctagatgtatattcaggaggaaagacacatatcaacttcaggacagctcagggagggagtggctatagggacaggaagttagagctttaattgtagatgtggccatatatgtatatatccttaaagagaaaaaaagggagatttgaaagcaatctagcaataatatctagatgatgtatatataaataaatacatgtacatatacttatataagtaaattttatatagatatttctaatactattctgatactacagtctgtaattttatatgtttgaaatattgaatagttggcatttctgcaaaaatgaaaaagccttcagaaaataaaaaaaacttcaaaacagctctaaaacaatgaaaatctttgtcagtaactatagttagggttcacaaaccttggaattgtatactgtatctgaaaacttggtatttaccaacatctcaagaaaaaatagatctaatttattttatttatttatttatttttattattattatactttaagttctagggtacatgtgcacaacatgcaggtttgttacatatgtatacatgtgccatgttggtgtgctgcacccattaactcatcatttacattaggtatatctcctaatgctatccctccccccagatctaatttatttataaacaatgctaatttttttttaatctgagccccataattatctttttaaacaaggaaactgcccaaaattattatgaagtcctaaaatcttttcagtgattatggatggcagttatcatatcctgcatttttatattttccccttagaaaaaggttaaattttctcgagttagataataattaccaagaattctcagtaagatgtgtttctagtagtactactaccttacttagaaaaagtggactttttatttctgtcatggtatatccagtttccttgatactgtgattaatgggcataattcaggaaaaatagagaccctcgaacctcctaatccccagccaaatctctgtttggtgtatttctgtgccggctgccccagagaagcgtgactggctttttcattggttctttgctttacttctgagctagaaagtttgcagaaagtttagtctgttttcatacaaatctttgcatccatctgtatgactggagtaactccatttcaaatatggatttggaaacaagggagtaggtgagtagggagagacaggatgtcattgaaaagttttttagtttcattttattgttttgtcttcattattttaatgacaattactgctgaaagtcaaacttccaaagaattcatgttaaatgttttccccctcaaaacatgcacaatttaaggtaaactatgtaatgtctagatttgtctcagcattatggggaagaacctatgctattttctatctaggaaaaaacaatcaattatctacctcattaatttaccttaggtgaatgagcatcttaattacttccttaggagctaaggaatttgattagaaaatatgattttagaaaaatcatgagtattttactctctaatcatatatatatttctctaacgttagcataatgattaatagaatgtcaaaagtagtaggaaccacaaactgttaatgtggctagacctgttgagtgctttcccatattatttggcggcctagtgggaactgcatgacaaattgagaagatactcaattgttttcattcttttctggaacatttatttttactgcaaaaattacagattctcaagagaaagttaaagtatttcttgctttcctgagagtaagccaatactgaattatcctgctaatgtctctgtttgttcaataaattgtcagataaaataatagaatgctcagaaaaacttttaaaaattacccttacataaaaagcctacatttttatatgatctggttagttcttagcttaacctttacctacatacttcctcattttaccaaaatagttcattatgttacacattagaacaaaattatttcagttagttttatcctcatttacccccaccttttatgccaattagtcttacatgacagcatcaatgcatttaaattcacaaagtatgtcctaattcagaacccatgtaaggcaatccctgtaggaatgaataatctacttacatacagtcaacttcctggccttaaacaaatagtattaagatattagataatatatgtgaagagcacttgagaaattagttctttcccctatttctgctctctcttctcgtaagatgagtgctttgagcgctttggcctccttttggccaatggtagatatttccttttttttttttttttttttttgaggcagagtctctgtcacccaggctggagtgtagtggcgcaatctcagctcattggaacctctgcctcctagattcaagtgattttcctgcctcagtctcccgagtaactgggattcacaggcatgtgctaccatacctggctaatttttgtgtttttagtagagatgggttttgccgtgttggccaagctgatctgaaactcctgacctcaaatgattcacccatctcgacctcccaaagtgctgggattacaagtgtgagccaccatgcccacccctatggtagatatttcaaaacttctttgtgaaaaacagggcagagacatacactaggtcaaattgctctgactctcactgcaacattagtaatttcagctgctattttattcacttcaggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcaggtttgtaaatagatgaacaacttctaactgatcttctagattgattttactattacgttgaattaaaagcactaaaattttttacaaagcatatggagagcaagtgatgggattttaatttttttgtaaaggttgtatgtggagcaaagtgtatttctgtagaccatcctataagctaaagtgagttgtcccaatttggataaatcaatgataaactatcattagtaataaaatatatgccattaccctgctgtttaaaatatttgagatttgcctctgatgttgcaatgtgggagtcttgttggcctatgtcttactttacaggatgtaaacaatatatggatgttttagaatgtagacttcagcctaaacaaagtaaatagggcttgaaagtatgctgataaaaattatctaaaaggttggtttataatattttgaatttaaattttggattcactcaaagaaaaatttcaaatatgagacccttcattaaatgtaaaaccaacagaaattcagtggtgaagaatctgctccttttgagtagccctaattaatgtggtgattgcttagagggttattagacttataactgagagtataactaggaaaccatagaatcacagctgagcttattcaatggtattcattgcaaaaattccattcagaacactagaatgtaaacttcatagggctgaagttttcctttttttatgtactgttctatcccttccatcaaaaacatgcctggcatgtaataggaactaaaatcctcaaatttgcagaacacatttccttatcattttcccaaagcaccctaatctttttcatcaattattaaaatgtgatatgtatatttattgagttaatacattcattgtttatgtcccactccagagtgtgagttctgttttatagtcctatctttcacataatacgtttaatgttaaatggattaccccaatgtatttaaatgtaaatactaaaaacaggttttaaaaggtttaggtgaattcacatctaatttttaggagttcctaagggaactcatcacaccgttgagccttttaatgttgatatcagctttgctatcccacaaaattaagtctgttaacatttaaaaatgctaaacagtaggattggagaccatgaatctttcccaatatgggaatttatatgttcttgatttaagggaaaagaaaatgttctttttttacttcctaatacagagcctttaattgatcactgcagttcttttagcggtaaacttgtttgtaatctctatagttgatgcttcatgtaagtcacttgttaaactgatgttatatactctttgatgttaatatttaaagggaatatatccaagggtgtgtgggaggcagttcgtatactacctcttatgtatagataccataggacacttacattgaattacatatttctttgtcatagaaaatatacaggacatttaagtgaaaaaatacaaagcacccgcctacaaacagaattcaccttctgaataagtatgaactgtagttgttagttaactaatcaaagttggggaaatatgctttgtgtgttgcttttgttgttttttgtttatttgtttgtttgtttgttttgagacagagtctccctttgttgctcaagcaggagtgcagtggtgcgatcttggctcactgcaatctgtctcctaggctcacacaattctcatgtctcagcctcctaagtagctaggattacaggcatgtgccaccctgcccagataatttttgtatttttagtagagacagggtttcaccatgttggccaagctggtctcgaactcctggcctctggtgatccgcctgccttgacctcccagagtgctgggattacaggcgtgagccaccgtgcccagcctgtgtatcgctttggaatccctgccttgaaaaatcagaaaattgttcgggagtagaaatgaggagaggataggtagaggtttatttgtgcacaccagtatgtttattattttatatcttgctgaagaaataacccaaaagaaagttaaaatggtcatgtacaataacatatgttacgtaataattattttttttctaagaaatggttttatataaagaacatcttcccaagtcattggctattaagcaaactcctttattcaattgcttggaactatattaagaaaagtgttatagatcatatacttgcttttacttttctccaacatggttatttcccaagaatgtaactcctttccagattgatttttccattaggtaccttttaatttctatcattttttctgcatacaaaataaatcatgtgtttgattcatttatttattcaacaaatatgtagtgagcacttactagaatactaaatgccattgtgctaaatgctagcaataaagcagtgaacaaaacggacaaaaacctgtcatgaactataccttctggtgggagagacagaactggccaacttaaatgaataacatacatcgtgtgttagatggtgctacagagaaaaatgaagcagagcaggaggtggtaagatgtggtggtcaaggtttgcaattttagacagtgtggaagaaaagacttgaaagaatcaagtgagtaaactcaggatatctgggagaagagcattctagacagacagaactggaggtacaaatgcccagagatgggaacatacctagaatattcaggcaatagcaaggaaaccagagtggttggatacaatgtggacaatgcattctatgtggttggagcagagtgatggaaggcaatagaatagaatagtaaccaataagatcatttagataatgatgggcatgaggagggaagaatgtatataataaagcatcttgtaggtcattggaagaattttgatttttattctgaaatgagaaacgattatggggttttgattcaaagagtaacatggtacaacagtttttaacaggcttattgtgactactgtattgagaataggcaaaaggaggacatgggcaaaataccctaactgggataccagttaggaggttattgaatgtgcaaggaagaaagtgatcagatgctgctgataactcaagtaggatggaactgagaaatgatcattggatttagcaatgtagaggttattgatgaccttgataagaatagtttaatgataggaattcaaaagccttgttggagtgaggtccagagagaactggaagagtggaagtggaggtagcaaatataaactctttcaaggtggtttggtgtaaagaggagagaaataggttggctgccaaggggtaaagagaattattttctttttactgaactgggaacatgtttttatgtggttggatatgatctaatagatagagaagattggtgatgcaggaaggagagtgaaagaattgctgtaggcaagagaagatgggatataatttataattggagggttagccctagctaggagtacaaacagttcttccatagtaacagatggtggagtcaatgggcacagtttctgtgtagatgtgatggtgggagtttgtggaagttttcttctgcttgcttctattttgttagtgaaataagacacaaggtcatcaaatgagatgagggataagggaaaagtagtggatggtttaaggagaaagaaggtatgaaataattatcttggagaatgtcagagtgaatcaactaaagaaatgtgctatgatcatcatgcatcattaaatgcccacataaggttagtgatcatgaatttaaagtaaacttgtcaatattgcctgtattcagctgtgtatggtgacatggagtaggtggagagtaggatttaagcagagttctgatttagccaggcagtattatgaagtaaggttagggcaaaggaatcaggaatatttacaagggaataattatagtggttcatcatggaatttaagttgggttagcagggcaatggggaaatgggtagaggataaagaatagtgaaaggtagtaaatagtagggcatggttagataaagaatggttggagttgaaatactatagagaaggatatctaaggatatataagatctctgtcagattctctgaatctgagccattgcctgcaatttgaagttgttatagtgatattacatagcatcgtttaagttttagaaacaagttttaagtacacgaattgtgaactccctagacagtacccaaattttagtattcttacctacattatgggctttgggactctaaaaggattttaatattactaaacagaattatatttaacaacaggaactctattgagtgtaatttttaaaaattactattatttaaaggccagtgttaaatgtgtacaaggcagcttagtatagcaggtgagagcatggaccacttagattcagttcatggctttgctgtttattggcagtgtaattttgactaagttaacttaacctctctgtgccttagttttctcagtctataaaacaaggagattaataatagatactcacagggttgctgtgatgattatgagttaacatacagaaagcacttaaaatagagcctgacacataaaaggactacattagtgctgctgtagctgctgtggcttattaggatttatactgaattaattctattgttgttttttgcttctttccaagactagcatcagaggtgctatacagagttaattgtcaattactaggggaaaagagttgaatatgttggttattttaaaatttatagcagaatgtggacataatagacaagaaatttgccatatttatgtatttggaatttttttagaaaggaaaggtgctgtttgaagaagaatataactttacccacttttcacacctttctgttttgaacaatggcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgagtaagcaaatgtctctatctcttctaatgtgccctaacatgttgaggattgtctaagatttttttaaacctcattttagacacatacctttttcagaagactcattttttttctttctttaaaaatatttttcataaaactgacagttgatttttaatcagatttaatctgacacttcatttttatttgacttggataaaggaatagtgtatttgacttctggttttataagagcaggaggatcaaaaacagttcacgaatggtgaaaaatgtaaagaataaagggtattttgcttggctttttaaaaagcttttaggtagattgtccagcttaatgagatttcaagaattgtcatcatgagtaggagcatattattatccgaattaaatattttcagtcctggagtttgagtttgatgtgttcaggcaatatagttgaatgatgtaggaagaaaatatcactgatcatcagagtaattggtacaaatttaagttcacaaaaaacattatttttatggaaaagcactattaatataatatttatagagatactgattaccatatatattagatcaacctaaaattgtatgttgtttgtactagagaataatattatgcaaataattattggaagttttatcatgaagaatttttatattctcacgtagctgtaattctcatcgtaaagtaatttgcccaaaggtagaatattaatgtagtaaagttacagaatataacaattaaataacggttaaaatatttggatctaggcactacactcaaagaacatatactcagaaatgaatttggagtgggagtcttgaatctgtttcctcagatggtcccaattccgtacccttccaaaagagtgagcgtcttgctataccaaataggattctagtttttaaaagacacggatctttggatgtgtagcgttctttttactatagattgcacattattgatgaggttatacatttatataaacattcatcaccacaattatacaaagcaggtacaaccaggtggtatattcttctttattgacaactttaagggatttgttaagggaaatttagacttttgactttcatgctgactttagaactaagccccaaaataaggtgtagagtcattagaagtagctaaaatatctttaaaaacagattatgagacatttaatctgacagtacttcaccctgcaaacagggctaagttagtaaattaaagagggagaatttataaaaagaaatatttttatagtttaatatatgtaaatggatgaaagatctaaatgtaagacctgaaactataaaaaggaagaaaacatagggaaaaagctttacaacattggatttgccaagggctttttagatataacaccaaaagcacaggcaacaaaagccaaagtagacaaaaatggactacatcaaacttaaaaatttctgcatagcaaagcaaacaatcaacagagtgaaaaagcaatatatagaataggagaaaatatttataaaccatatatattataaagggttaatatgtagaatatagttaaatatttgctgctagataaagctgtttggtttggtataaccagtatggttgatctgtattactgctgctgttgaaaaatgcaactgtaagaaaataatgttcatataggtctatagactttagttcttatgttttgggaatatcccctatggatatttcttttcattggaaaattttgggtaaaattttagcaaattgcctacatctgctgatttagcaataaaattttggatcatgggaacctaagttaagcttttctcaagtggcagtttttagttgggtttagcaaggtattttcgtgttgttgttgttcttattgttgtttcctaacaatctatgtggctcctaggcccctgagttctcatcctttgcattttctaaaatttttttttaagcaaaaaacttttaagtttggggagattatttctctaatagcatgagtaatatagactttctagagataatctcacttttttctacagaaataagctattattcagcatattaaaaactgttttggccaggcacggtggctcacgcctgtaatcccagcactttgggaggccgaggcaggcggattatgaggtcaggagatcgagaccatcctggctaacatggtgaaactctgtctctactaaaaatgcaaaaacttagctgggcacggtggcgggcgcctgtagtcccagctactcgggaggctgaggcaggaaaatggtgtgaacctgagaggtggagcttgcagtgagccgagatcgggccactgcactccagcctctgtgacagagtgagactctgtctcaaaaacaaacaaacaaacaaaaaagtgtttctatcacattctaccagctagtattatacctggcagtggctgcagagctctgcaagtagctcagcggttacaaaagatatagaagatgtgagtaattccctgaaaccttattggcttcatttcctaagagtggtcaaggtacagattagtgagtttatttcatgttaaacacactcaggaaatataacttgtttacattcattgttactaattaataacagttaattacttcagttaagtatgacatggtattccaataataactttaggcaagagaatcacttgagccgaggagttcaagaccagtctaggcaacatagccaggcctctctctgcaaaaaaaattttttcagttgttaggcatggtggcacacgcctgtagtcacagccacttgggagcctgaagcaggaggatcacttgagcctaggaagtcaaggctgccgtgagctgtgatcatgccactgcactccaacctgtgcaacagagcaagactctgtctcaaaataataataataataataacaataactttaatttacattttattcccttcctatgtattttcttccatgactttttctttctttaatatccttgtatgtcagatatttaaactaacactgtttgtccactaagcaatgagatagtttcatttcggcgttagtatctgctgcatggtgacctggtctgaaactaactgactatgacatataatgaaattaaacagatactgctctctaaagtcatctttggcctatatcataaaatgaagcaggggcaggatatttttattcctcccttttttcctgtgtggatcatgctgatgaaaacttagttttgtagagcagagtttaactatacctgttgtttttacttgcatgtggcagaaacagccactttaaaactctttgttttattttattctattttattttaaagagtccctgagggcaggagctctatctgatgtttatttatctttatattccagcttcccacacagtacctacgtatcacaggcacacaagaaatatagtactttttgaagggaagaagaaaggagttcagccagtgagcaaacaaggttttcagtgcagtattgttggctagataatgcacagtatgtggctatgcgcccaccttttgaaacatttttaactgcttaaatagtgtctgttattccatacttggcattttaggccttctttaaagtctcttgattctcaagttagtgcctctagcattaccattcctttatggaaattttgaagtagactgagaacaatagggttaatgaatgaatctgaggaatacaaatggagcctgttggagattaatgttcaaacatcatgtcttttagtcacttttaatctttacttttgaaataattttctcctcctttattttactgtttctaattaaaatctttattctacagccacaataccaagacaaccacctggttggatcctcgtctttgtaagaaagccaaagcccctgaagactgtgaagatggaggtagagattcagaaacttactctatcatacttattctcttaatcctttcttgctcttcttgctcagataatgggtttttcaaaaccctaaacaaaccataatgtacacaagcaaaaaagcagtgggtggatatcataatcaactgattgtggtaattatgtcattacatctaactttatgagagatttcatttctttttcaggattacataactctctataaaaaataacaacaacactaaaatacatttgcccttttttgacatctgtcctgaagacagacttttaaaattctaaataaatatttaaaaattaggcacatcctcaaccataagctaggtctatcatgtcttatgaagtttttaaagtatatttaatttagtatacattacagtagatatgcaagtatctatagctattcttagccatttacagcagcagtagaaattcaaggaaagtctttaatataggcccccacacatatacacacttactttttactgcttaaaggaaaaattatttctctaagaatcatcagataatagcacttatctgtcctatatattataggttatatttaacagtgtagttttgagctgggtgtggtggcacaaacctgtagtcctaaagctatatggggagctgaaatgggaggattgcttgagctcaagagtttgagatcacagtgagctgtggtcatgctactgcactccagcctgggcaacagagagagaccctgtctctaaaaactaataaataaacaaattgttaaaaagagtagagttttgtaaataagtatagaatttattccatccaaaattgtttgctatgtctttaccttaggagatgaataaaatttgcatttttgtattactaatcagaaactatgtattaattggttttaaaaaataagtggcgtaaaatgaggttcacagtagtcctccttgtattgaagtccaatctataaaaagaaattaaacagaatttccacatatattgttcagcatgattataatataatattaagagttttctaggaagaagcaatcagaaaatggaattgtttaaaattccctctacaatggcatcaaaaaagttagatagcttgaaacaaatcttctgaacaatgtgcaagttctcaacactaaaaactacaaaacataattgaaagacataggaagacttaaaataattgacaagaggctgggcatgatggctcatgcctgtaatcacagccaaggtggatggatcacttgaacccaggagttcaagaacagcctgggcaacagggtgaaaccctgtctctactaaaagtacaaaaactcactgggtgtggtagcatgcgcctgtagacccagctactcaggaggctgaggtgagaagatcgcttgagtccaggaggttgaggctgcggtgaaccatgatcacgccactgcactccagcctgggtgacagagtgagaccctgtctcaaaatactaatactaatactaatactaataataattgacaagatatattctgttcattagccaaagaaccttaaaaaaaaaaagacaaagttggaagacatagggtaccagatctgaagacttattttagagctacagtgataaagacagtttggtattggcataaggatagataaatagatcagtggaacaaaatagagagtctagaaatcaatacacatgtatgtagtcactttattttcaaccaaagtgccaactgatatggaaaaatgaacctcaattatgcctcacttcatacaaacagttaatttcagatgaatcaaagacctaagcataaaagctagaaccacaaagcttttggaagaaaatataggagagtgtcttcatgagtcagaattggcaaagatttcttaaacaggccacaaaaaatatgaaccatagaagaaaaagttaatattttgcatgtaatagaaattttaaaattctcttcatcagaagacaccattgaaaaatgaatagacaaagtcacagactttgcaatatatatttgccaaaggaattaaattcagaatctataagaactgtttacaactcaataatattgccaaattttaaaatgggcaaaatatgttaataaacatttcaccaaagaaaatatacaaacagcccataaaaacatgaaaagatatttaaaattattaatcattaggtgttttgcaaattaaaaccactgtgatctactactttacacccactagaatgagtataacaaaaaaaaaaacagatggtaactaatcttggggaggatagggagaaacagtaacccttgtacattgctgtgccattggaaaatggtatagccactttggagaacagtttggcagtttcttaaaaggttaaatataaatttaccatatgacctagtaaattttctcctaggtatctacccaagaggaatgaaaacaaaagtcctcataaagacttgcatgcaaatattcatagcagcactattcataatagccaaaaagtggaaaccacccaactgtccattaaccaatgagcagataaatcaaatgtgctataacctacaatggaatactattgagcaataaaaaggaacaaaatactatacatgctatatgtatgaatctcaaaaacatgctaagtgaaagaaattagacataataggccagatattgtatggttctatttgtatgaaatgtccagaataggcaaatctgtggaaacagaaaataggttactggttgccttgggctaaggataagaatagagattaactgttaacagcatgaggaatcttcttggagttatgaagacgttttaaaactggattgtggtgatggttgtacaattcagtaaattattaaaaattattgaactgtatacttaaaacagatgaattgtatatatgtaaattatacctcaataaagttgtttttaaaatggccaaaggacttatgcacttcacaaaagaagataaaagaagagtcaagaagaacatgaagaggtgcttatcattagttatcactacaatgagataccatcaacacccactacaagggctagagataccatctacatcctttagaaggactaaagtacactgacgctcagcagaaaccttacatgccagaagggattggagttctatctttaaccaccttaaacagaataagtgtcagccaagaattttgtatccagcaatactaagtttcataaatgaagaagaaataaagtatttttcagacaagtaaatgttgaaggaatttgacattaccagatcagccctacaagatatggtaaaaggagttctaaatcttcaaacaaaaagttgatatgcaccagaatagaacctcttgaaagcatgcaacttacaggactgccaggcacggtggctcacacctgtaatcccagcactttgggaggctgtggtgggcggataatgaggtcaggagttcaagaccagtctgaccaacatggtgaaaccccatctctactaaaaatacaaaaattagccagacatggtggtgggcacctgtaatcccagctactcaggaggctgaggcaggagaattgcttaaacccaggaggtggaggttgcagttagccaagattgcaccactgtactccagcctgggcaacagagcgagactctgcctgccatccccccaccccccctccaaaaaaaaactcacaggacctataaagcaatagcacagtaaagaaaacaaagtactaggtaacaatcaacatgatgactggaatagtaccttatatctcaatattaatgttgaatgtaaatggtctaagtgctcacttgaaagaagaagattggcagaatggataaaaattcacaaaccaaatatctgctgtcttcaagagattcatctaacacataaggattcctatagactcaacgtaaaagagtggaaaaagatatttcacacaaatggaaactcaaagtgagcaggagtagctattgttatgtcagagaaaacagattttaaagcaacaacagttaaaaaaaaagacaaagaaggtcattatacaatgataaaatgatcaacaagaagatattgcaatactaaatatatatacccctaactctagagcccccagattcatgaaacaattactattagacctaagaaaggagatatcaacacaataatagtaggggacttcaacactccactgacagcactagatagatcattggagcagaaaatcagcaaacactggacttaaactacactctagaacaaataaacctgacagatatttacagaacaattctaaccaagaactgcagaatatacattcttctcatcagcacatggaaccttctgcaaagtagaccatatgataggccacaaaacaagtctcaataaatttttaaaactcaaaatcttttgtgggcatttagtgctataaatttccctctgcacactgctttgaatgtgtcccagagattctggtatgttgtctttgttctcgttggtttcaaagaacatctttatttctgccttcatttcgttatgtacccatgcccacaagagaaagcaggaaagagccaaaattgacatcctaacatcacaattgaaagaactagaaaagcaagagcaaacacattcaaaagctagcagaaggcaagaaataactaaattcagagcagaactgaaggaaatagagacacaaaaaacccttcaaaaaattaatgaatccaggagctggttttttgaaaggatcaacaaaattgatcgaccactagcaagactaataaagaagaaaagagagaagaatcaaatagatgcaataaaaaatgataaaaggggatatcaccaccgatcccacagaaataaaaactactatcagagaatactacgaacacctctacgcaaataaactagaaaatctagaagaaatggataaattcctcgacacatacaccctcccaagactaaaccaggaagaagttgaatctctgagtagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaactgaatccagcagcacatcaaaaagcttatccaccgtgatcaagtgggcttcatccctgggatgcaaggctggttcaatatacgcaaatcaatgaatgtaatccagcatataaacagaaccaaagacaaaaaccacatggttatctcaatagatgcagaaaaggcctttgaaaaaattcaacagcccttcatgctaaaaactctcaataaattaggtattgatgggacatatctcaaaataataagagctatctatgacaaacccacaaccaatatcatactgaatgggcaaaaactggaagcattccctttgaaaactggcacaagacaggggtgccctctctcaccactcctattcaacatagtgttggaagttctggccagggcaattaggcaggagaaggaaataaacggtattcaattaggaaaagaggaagtcaaattgtccctgtttgcagatgacatgatagtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacatgaaggacctcttcaaggagaactacaaaccactgctcaatgaaataaaagaggatacaagaaatggaagaacattccatgctcatgggtaggaagaatcaatatcgtgaaaatggccgtattgcccaaggtaatttatagattcaatgccatccccatcaagctaccaatgactttcttcacagaattggaaaaaactactttaaagttcatatggaaccaaaaaagagtccgcattgccaagtcaatcctaagccaaaagaacaaagctggaggcatcacactacctgacttcaacctactacaaggctacagtaaccaaaacagcatggtactggtaccaaaacagagatatagatcaatgggacagaacagagccctcagaaatagcgccgcctatctacaactatctgatctttgacaaacctgagaaaaacaagcaatggggaaaggattccctatgtaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatgagcaataaaagccaaaattgacaaatgggatctaattaaactaaagagcttctgcacagcaaaagaaactaccatcagagtgaacaggcagcctacaaaacaggagaaaatttttgcaatctactcatctgacaaatggctaatatccacaatctacaatgaactccaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaccactgttacaccgttggtgggactgtaaactagttcaacccttgtggaagtcagtgtggcgattcctcagggatctagaactagaaataccatttgacccagccatcccattactgggtatatacccaaaggactataaatcatgctgctataaagacacatgcacaagtatgtttattgtggcactattcacaatagcaaagacttggaaccaacccaaatgtccaacaacgatagactggattaagaaaatgtggcacatatacaccgtggaatactatgcagccataaaaaatgatgagttcatgtcctttgtagggacatggatgaaattggaaatcatcattctcagtaaactatcgcaagaacaaaaaaccaaacaccgtatattctcactcataggttggaactgaacaatgagaacacatggacacaggaaggggaacatcacactctggggactgctgtggggtggggggagtgggaagggatagcattaggagatatacctaatgctaaatgacgagttaatgggtgcagcacaccagcatgtcacatgtatacatatgtaactaacctgcacattgtgcacatgtaccctaaaacttaaagtataataataataaaattataaaaaaaactcaaaatcatatgaggtatcttctcagaccacagtggaataaaactagaaatcaactcctaaaggaaccctaaaaactatacaaatgcatggaaattaaacagtctgctcctaagtgatttttgggttaagaacaaaatcaagatggaagtgttaaaattatttgaaatgaatgataatagtgacataagttatcaaaacctgagatacagcaaagcagtgctgagaagaaagtttatagcactaaattgctacatcaaaaagtctgaaagatcacaaattgacaacgtaatgtcacacctcaaggaactagagaaacaagaacaaacccaaagttagtggaataaaagaaataacagaagatcggagcagaattaaatgaaattaaaacaaacaaaaacagtaggccagatactgtggctcatgcctataagcccagcactttaggcggccaaggcaggcagattgcttggtaatttgagaccagcctaagcaacatggtgaaaccctatttctacaaaaaatacacaaattaaccaggtatggtggtgcccacctgtggtcccagctgctccagaggctgaggtgggaggattacttgagcctggaggaggcagaggttgcagttagacgagactgtcccactgcactccagtctgcgaaacagaacgagattgtctcaaaaaataaaaaaaatcaaagtgtgtgtatgtgtatgtatacacatatatatatatgtgtatacatacacagaagatcaaagagacaaaaagctggttatttgaaaaagatatacaaaatttatagaccattagctagattaaccaagaagagaaaaaattcaaataagcccaattcgaaatgaaaatgaaaatgaaatggaaatgaaaatgaaaatggagacattacaacaaacaccacggaaatacaaaagataatttgaggctactatgaataagtgaaattgaaactgtgcacacaaagtagaaaatctagaggactggataaattcatggaaacatacaaccctcctagcttaaatcaggaataaatagaaatcctgaaccaataactagcagtgagattgaatcagtaatttaaaaattgccaacaacaacaacaacaacaacaacaaaaagcctgaggccaaatggatttacagccaaattctaccagacattcaaagaataattggtatcaatcctactgaaactattccaaaagattgagaaagagggaatcttctctaactctttctatgaagccagtatcaccctgataccaaaaccgggaaaggacctaacaaaaaaataaaactatagaccagtatccctgatgaaaatagaaagaccccaaaagcaaatgcaacaaaaacaaaaataaatgcgacctaattaaacaaaaaagcttctacacagcaaaagaaataatcataagagtaaactgacaaccttcagaatgggagaacatatttgcaaattatgcatccgacaaaggaccaatatccagaatctacaaggaactcaaacaagtcagaaaaataaataaataaaacccaccaaataatgccaccaaaaggtaaaaagtggacaaattacatgaattggcatatctcaaaagaagatacacaaatggccaacaaacatatgaaaaaaaatgctcatcatcagggatgcgtaaattaaaaccacaatgagataccaccttattccagccagagtaataagtcaaaaagcaatagatgttggcatgggtgcagtgaaaagagaacacttatacactgctggttggaatgtaaattagtacagcctctatggaaaacagtatggagcattcttaaagaactaaaattagatctaccatttgatccaggaatcccactcctgggcacctatccaaagaaaaagaagtcattatatcaaaaagacacctgcttatgtatgtctatcatagcataattcataattgcaaacatgtggaaccaacttaggaaccaacctaagtacccatcaaatgatgagtggataaataaaatgtggtattgccaggtgcattggctcatgcctgtaatcccaacactttgggaggctgaggcgggcagatcacaaggtcaagagatcaagaccatcctggccaatatggtgaaaccccatctctactaaaaatacaaaaattagccaggcatggtggcatgcacctgtaatcccacctactcgggaggctgaggcaggagaatcgcttgaatccaggaggcggaggttgtggtgagctgagatcatgccactgcactccagcctggcgacagagtgagtctccatctcaaaaaaaaaaaaaaaaaaaaaaaaaaaaaagagaagaaagaaaatgtggtatatatataccatggaatactacccagccatgaaaaagaatgaaataatgtcttttgcagcaacttggatggagctggaggtcattattctaagtgactcaggaatggagaaccaaatactctatgttctcacttataagtgggagctaagctatgggtacacaaagacaaacaaagtcgtataatagacattgaagattcagaagggaggagggtcggatgggggaagggataaaaactacatattgggtataatgtacactacttgggtgatgggtgcactaaaatctcagatttcaccactatacagttcatccatgtaaccaaaaaccacttataccctgatataaatatacatatataatatataatatatgtaatattatttttagatatagtaaaataaaatatactgacaataccaaagattaatgagattttagagcaactagcattttcatttattgtgagtggggacacaaaattacctgaacattttttagaacttttcacagtttcctatgaggtaatatctaaagagaaatgaaaacatatgttccccaaaagacttaactagaatgattatgacagcctttctcttaatagctcaaacctggaaacatcccagatatctatcaagaagagaatggataaaccatttgtggtatattcatgcaataaaatactactcatgagtaaaaagaaaaaagtgttgataacactcaataatatggatgagtctcagaaacatgttgtaaaagaaaccagacaccaaagagtaggttctcaattactcattatttaaagcttgagaacaggcaaaactcatgtgtggtaatagaaatcagaaaatgactggggagagtagaagtggggtaaagtgagataattccctggaatgctatattctccatctcaattgaggtgacagttacacaggcatatccagttgccaaaacccactttttataattgaacaagcactcgattttttttttccccgagacggagtcatgctctgtcgaacaggctggagtgcagtggcgcaatcttggatcactgcaacctctgcctcctgggttcaagcgattcttctgcctcaacctcccaagtagctgggactactggcacatgccaccacgcccagctaatttttgtatttctagtagagacggggtttcaccgtattggcgaggctggtctcgaactcctgacctcgtgatccgcctgcctcggcctcccaaagtgctaagattacaggtgtgagccactgcacccagccagattttttttttaccattaaaagggcacttaagagttgtgcattttattgtttgtaaattatacctcaattattattctttttttgagacagagtctctctctgtcacccaggttggagtgcagtggcgcaatctctgctcactgcagcctcctcctcctgggtccaagtgattctcgtgcctcagcctccccagtagctaggactacaggctcatgccaccatggctggctaatttttgtattttttggtagagatggggtttcatcatgttggccaggctggtctgaaactcctgacctcaagtgatccacccacctcaggctcccaaagtgctgggattacaagtgtgagccaccatgcccagcccaagaaataatttttaaaataatttttataccgtagttgtttataaagctttccatagtaagttccttcttatggtgaaatcagccattctaaaggcaaactagaatatataatactatagaatttgactttttttattgtgaacatggtatttgtcttctagagcatgtcccttttactggcttccattctttttcctggtccctaattgtttcagttcagttttctgccttttcttgttttcttttgtagaaagcatttattctcatagctttatcagtttactatagcctgccccattatcaaaatctctagtattgtcctttgttctgaattatatttctgtttcctcttgcttttgagtcttggttttgatttccctactaatacttcaaataagcttatttaaaactaaattgacatctttctcctaatacaacccgtccctctttctgtcatatacgtaccattctcataatcatctatgccaaaatctttgcaattatgtttgcctgttcctctcttcttgctctacttcctgatttagttttcacgtcctgttgctttttcttttttctctttttgccaatatattattatgcaaaagtttcaacatataggaaaatgaaaagaatcatacagtgaacatacatatgcccaccactaggatattacaattaacattttgctacatttgcttcttcacatgattattcatttattctttctctatctgtgatttttcttttatattatatattcctttccattctcctaatcactacacacttggattattcttggtctttcttcctccagttatttctctctctttaatacatcttttatgccagtggttttcaaaatgatcatactcaaactatctactggtacccagtagaaaatattagaactaatttttcataatgttgttactgaaagaaaaagaaacaaactaagcttcactactattttacatacagattggtaatggcattcttactgattccgtatgtcggattatcacatactctaaccagagtgccttgagggaggaatggatgagacacctttgctcttttttcaaggacactgtgaaattttacagttgatttgtgcccagttaagtggatttatagactagttatatagtttttaaactaacctcacataaaatggaaatgtcactttaaaagatttctacaaaaacactactgattgaagatgatacaaataggcaaacccagactaatagcaagaaaatggaagaaccgatactgtttgtgtatcatatatgaccatatataagcttttttcaacttcaaggtaaaatcatgataattgcttgtttaatcacctcctttaaaaacatctatttttgtatatgttttattatatacatattagaagaggggcagatgtcagattttttactaaaaaggctacatgatcaaaaaaccttggagatattatgtaagaccaaattaatctttctaaaactaattttctatctatctctcccttgctgtccattgtcagcagagtaaagtccagactccttggttaagtattaaagattttttataattgaatcatattctatatttatttttcaaagtattctcatgtcataaatctgacatatttttcgtctttgccatatacccatttcttctgccaggaatcagtcttgtttcctgtgtctacctggctcatacctattatccttcgaagctccaatctaaagtataatttctttgtagccccttctgtcattttcttgcaagtcagaagtagacgtcctctcctctgtgctcagtagtaccatatgacatgtctctcttgtagcagttatattgcattgtaactagataccacactcagagcaatgatttttgacacattcatctgtatatcctttcagtagagacttcaatgtttgaaaagagggaaagagggaagagagggagggagggaagaagggaaaaggaagagaaagggaaaaaaagaaagaagctactctatcctccagattattttggtcgcccttttggaaatacttttcaatctctataaggctctgaggggccaataaataataagcccgtcttcattcaccagtttatagtcaatagagaaataagacaccagagacagacagatgaagtcagaatgtcagcaaatgaatgttagccctgcatgtacatggccttgctgttattttacccctgcaggagggagacatgagtacttagtctttggcctctgtgttcaactgcaagcctcctcccaacgggcagacatggcagagaacagaccagaatacgcctctgcaggcaggctgttaaccaaaacagtgagagaactcaagagtccctgagccaagcatattgagttcattgtgtaaaactccccagtcagataagacattctttcttccttggggaagaaagtgaaggggctccgagaaactggaaatgttcctcccattctttattctctaaggaatttgaagaattggatgaacatttccccctaatgctctttacattaaggctgaacatatgtcttggttggcccaggactgatccagctttttcctgttgccccaacataattattaatagtatccccttttattctcaaaagtggacagtacattttatgatcatcctaagtatatttttcttaaaatagaatgatcaaaattgcattcagtattctgggaatgtttgaaactctttaatatgggctactctcccacttacaaaactgggtacacctttttaacattgcctatacttatcttcgggggagcctacaatttagaacattgagtctatttgttttatgctcagccagccttttccactttcctctctacactttgtctccccacgtaatagccccacggaagactattttcaggatgaactatgtgtgattcatattagtattctctgcagtgctttgcacagagtagatgctgaaaagagaagaataatattttaagtgtaggttttataggttaagatattgtttacattctgctgaacatttaagatcttctagaaagaccttacagtttctaaaacatgcccttttcttcccagtcttctgatattctgaacacagctgtgtattcaaatacagtgtaaggacacagcttgaacagcttggtttaattgatgtacattttatcttctattcaaataaaatagtgttttggttaggtagttgtcttgaaaatacaacattaggaattcgttttaccctcaacccatcccatttctcttatgatgaaagaaagattaaatttttgctaaaggcagcttacaaatatattgaatgttgatatttcagagcttagagaatgattaaaaaaattatcaactgaatagagctccaccatgagaaaataattgtaattcttacatttaaacaagaaaaatcctatttggggaagaggaaagaaagataaattcatgggatttagaaccaaccagctgcttgatatgcccaaaatagttttgtcttttgaaatagctttttaggggaatactttggcttcatacacaggaaaagatggttaggttaggtctttcctgtatcaaaaataaacaaacaaattttctcttggccctaaccctccccatagtttttatactatcttttccacaagcaaatttttgttttaagtcatctattcttaaggactctacttcgtatttttctcttcagttactacagtattctgacttttgcctcctaccttttcagggttaccagtaacctcctgatcttatagactctttttagcccttatctttatgcctaacagctttacaaagcgtttttttgtttgtttgtttgtttgtttgttttgagacagagtcttgcactgttgcccaggctagagtgcagtggcgcgatctcggctcactgcaagctccgcctcctgggttcatgccattctcctgcctcagcctccccaacaaagcgttttttaatgctgaccatgcccttcctcttctgtcttcttttacaccattccccctgatgattcttactttctccatctgccgcttaaaatgttagtgctcctaaggttctgttcttcacctttctctgctcagtttatctaggtaatcatgtctgctgtcatagctttaactacaatgtctctcaaatctttatcttcttatatttctctttggagtaccgggttcatacggccaagagcttgttatttatctgtaccaggatgttctacagatcactcaaatgtaacaccttcccttcctgccttcaacagatatgacatccccccagctgcttgagccaaaaactggttgtcatcctcgcctttccctcactgtctcctctctgttgcagttaactaccaagttctatcaattctaacttttaaaaacctgccattcgggtggatcacgaggtcaggagaccaagaccatcctggccaacatggtaaaaccctgtctactaaaatacaaaaaattagctgggcatggtggcacgcacctttagttctagctacccgggagactgaggcaggggaatcacttgaactggggaggcggaggttgcagtgagctgagatcatgccattgcactctagcctggcgacagaggaagactccatctcaaaaaaaaataaaaaataaaaacctgccatttcttgagtgtccattggtggtagacacattactaggcacttttaatatatcatctgtctcctaaattcctctaaatccacattaatttctaatttctattcccacagccattttcataattattcttttttttttttttttgagacagactctcacactgttgcccaggctggagtgcagtgatgagatctcagctcactgcaacctccacttcctaggttcgagcaattctcctgcctcagcctcctgagtagctgagattacaggaacctaccaccacgcccagctaatttttgtatttttagtagagataggggtttcaccatgttgctcaggctggtcttgaactcctgacctcaaatgatctgcccacattggcctcccaaagtgctgggattacaggcgtgagtcaccgtgccggcccattttcataattattcaataaatatttgataatgtatcacttttatgccacaaaagctagaaacctgggaatcatctttgcctctttcctcccttcccttcctcaatcctcatggtagtcattaagttctgttactttaccttctttgttttattatccattctactacccctgccttagttccagtcttcacaagttcttatgcagtctattagtgtttatcttatttgtctgcctttattctcattgcacaccatctatttcgtcctttattactgcttcccataatctttttcaaatataaattaaatcatgtcacagttcaccttaatcaattctctatcatcgtcaaaataaagatcaaacttctcaacacagcactctaagaatgttggaattttgtgcttgttcataaaattcatttccctttgcatacaactttcattctagtttaccaaattatttgtaattatggaaaataccaagcattcttaatacctcaatgccctttaatctatctggaatcatctccctctccctaatcccaacttatttatttatttatttatttatttatttatttgactcggtctatcaccaggctggaatgcagtggcacgatcttggctcattgcaacctccacctcctgggttcaagtgattctcctgcctcagcctcctgagtagctgggactacaggcgtgcaccaccacacccagataatttttgtatttttagtagagacggggtttcacaatgttggccaggatggtctcgatctcttgacctcatgatccgcccgccttggcctcccaaagtgctggaattacaggcgtgagccaacttatctttaaagactgcttaaacatcagcttttagcaggctttcctgatagcaatcttaccaggcaattggtattcctctgcactccccaaaaaagattatgtttatctttatcttatcatttatctcttctgtcttcctgtctagactataaactccttgaagtcaagaactgggttatatttctaatttttatttctgcataaggatgatggggagaggaggatgagaagggaggaaggaaaaaagaataaaatgaataaatgaattgatccactaaatagtgtataaagttgctaggtattttagtcttgatttttattaccttcactttaaatgagcaaataataaccacttctttatctgtattaaattgccctgtgtgaaaacaaaacaaaaccaaacaaaaaaaacttgctaatggtatcagtggtaaaggtgtaaaattaataaagtaacccagaagataaatggctgcatttgtttgccctcctaaagaaaggactgttaatctcttagttgctaattaccttgagtgctaactaaaatgctaaatcaactttcaagttaagattaaaatatatttatgttgatcttttatccttactattagtacatcccttttagtgaatttttcagatatcaaatggactatttcagctatttctatagtccttaatttctccaaacttctctaaagacaaaacataaatctaattgtggtacagttgtagaattcctccttactcagctctattcagttcccatgctatttcaagaaaatttctattaaagaaaaaaatatttttcatggaagatccataactgttatagtgcagttttacagatatattcaaaaaaattactcttatccatgaaacagttgtttggcgataaaatattatatctatttgatagatttgcttcatagctaaggaggattaaagtgaactaaagtacatctcagttctttttaatgttttgttctcttctcacatatttcaactattttagtatttcatttgttctcatctttcccacctgagacatttcaaccaggtccttcaaaggaaaaacacaaaaactcatcaaactttgaaaccaccaatcaatatatatgcagaaaagtatggtggagaaatggggtaggggtaattcagacattttcaccaggaggctagtcatctgttcttttcttatattctgaatgcagaataataatttttcttagagtaaaacagtatagcttgtcaagtttattataatggaatttttacttacaaagttggtatgtcataactgaggctaaatgatataaaactaataagtcttgtgatgctttctaaacctgtttgctgtccagcgtactttttgtgtgtgtgtctttcagcagagcagaagcattcttaagagaaattgaaaataaaagcgtgggacatcatagtgcacaacagtggacttttaaaaaaattcttttttgctcaactgctatataaaatggataggactagaaccacctgctaggaacattcttcccaacttatccatgttttactaataagatggttcttcagaaaccttaactttacaaggaatgcagacaaagtgggagggaaaagattcacattcacattgaaaagctcatgtcagttcatgttgaaaaggctagagatttgttttaactttcagaaattcaactaccttcagtatttctggttatattttattggtcacttactgagaattagtaatatataaaaatgctatgtaaggtatttatttgttatcattcacaaatacagattacacaaagcactgtggtagttagattagtgttccttcagatactcagatcttgttcaccaagagaaagcaggtacttttgtaggttttaagcaaatctagattgctcacttgaaatgacaaaagtccaaggctagggtttcctttgaggagaagtgggtctgaacataacatcaaaaatgactatgtataatagtaaaaaattgaacagatacctgcttcttctattggactacaagggtaaatatgtcttgtgtcagcatgatcaaggtttttaaatgaaagaagtacacagtaatttttattagcatttttatggcttgtggttcatatgaacacctttttgtttaatgccatcttctgttctgggcttctgattgcttgctgaaattctcactggctggtgaagaagccactcagacttaaattgtgtttgttccttgaaagtgagccctcagctttctgacacccaaatattagtataatgaaataataaattcactcactggtgaattcttttctgtcagttttgaatctggcatttcactcaattttctttatttacagagcttccttatggctgggagaaaatagaggaccctcagtatgggacatactatgttgagtaagtttgttacctcagttaatattctcccaaatattttcctttcagcatatagctttagagaatactggatacagcactttatgcttctgtgatccagctgttgagtttttcaactaggggaatgaaaaggtaggggcagtgagcatttgcttcattgaccttgggcttcctggaagttggctttgaatttctaaatatagagaataagggggaagttgcctagacaattaatagctagagatggtattgttactactacagcctctaaagagaaagtcagttgatagaaaactgaaatgagggcaacagactagatgaattatcaaggtcatttccaacactaccactgtatccttctgaaagcagtggaagatctttagggcattataacataattatctgaagttttgaagcatacacctaaaggtgtgctctcttttaaggagttattcaaggaaaacttagtattctttttaggggtgaaagttgcttcttaggcagctgctatggttaaatttaaacataaatatatattggagaggagtgccagacacctgcctatgttagccagagaaattaagctaatatcaatgtctaattttgccttctcttttctttatctaattgctacaatgttatgaccattgggattgctttctttccagatgctaaacactgaatttgacctcaagcgtctagcagcaggcaaatacttctatcagaaacattactatttacctggagactaggagttaaacctgctgcctaggtagcaaagacaaaatgttattattacctgaaaaagtaacaaacacaatcatctttaattttataattgtttcttaatgtttcaacacttataggcataaaccaatgccatttcctggtagttatccctaaagtaagtatctctgactcctgttgcaactgtagtctttattctattgtgcaggttgttacttgagtcactgtggttagagggatttttggaatgacttcttaaaattaaatgtgtctcctaaggaaatgactcaattagattgacacttaagtatataactttagaatttcaatatcttggttcctttgaaagctatgctaattttgtttccattgtgttacttaatgtcttactgatactgtgatgtaaaaagtatacagcagctcttttattattattttttcctaagacttattttgttaaaggaagaaacaaccatttttcacatcaaaggagtatttgggggccgactgaaaaggttttgcaggatttttttcttcccctcaaagtttagtctatttaaattgggctctaatcagctatttgccattgacactgctgaacatttctgagataatgattctcattctctttattatccattccaagtgaatttgaatacatggtcaaaaggtgaaagtcatttgcctgttataaaaccttgagctgaatgatctggtccccattatgcaaagatataatattaaagcaactttagggcaaatcctgaagcgacctgctcctagttgtcagggaggtacatgaaatagcctgaattagaagcaacagcagcagcgacatgattttgtatgattattcccagaatgagctcattttacaggagggttttgtattagactaagaaggagcagactgtactcaagatgcacattagtatggagtcagctgagctgtggagtgtggcttgattcccagattagttaggttttgaatctcgaccatagtaatctgcagtgagtttactgatggagataaaaagctgttacttgaatggctactctttggctctcttagtttgtcaaaccagatggcacgatgattgctcttggcaggagccttgtagtagtaacaccaactgcagtggtagtttttctttgtatttattttagaggatgggattctgaaatggatgaagttattttttaaaataaaatttttccaaaaatgtaatatgcttataatatgcataaatataaatatgcataagctataaatatgcttatatatttagaaatgcggtcttgattatattgcattacatgtctttttaaaattaacatataattatacacattttgggggtacgtagtgatgtttcagtacacgtaatatatagtgattagatcagggtgataagcattaaatgtcttgatgcacctagatgacaaagtcaaaatatatacttgctttcacaactaaaacttttttttttttttttttgagacggagttttactcttgcccaggctagagtgcagcagcacgatcttggctcactgcaacctccgccttctgcctcccaggttcaagtgattctcgtacctcagccccccagtagctgagattataggcatgcgccaccacacccacctaattttgtatttttagtagagatggggtttcaccatgttggccaggctggtcttaaactcctgacctcaagtgatccacccgcctcggcctcccaaagtgctgggatcccaggcgtgagctaccatgcccagccatctaaaactctttatgaaagaatattttgttgagataaatttttaaatccagatattagacataaaattttaatacagaaaatgtgtcaaattgtgtactaatatttaatcattcttgtttgctttgtttctttctgataatctgtaatattctcctctcttatttcccacagctagttatttggaaaacaaaatttgttgtgtcttaataatagtgtaggtataagtaattaaatgaaaaggacagtattttcacttttttattttttgattttttttgagtggcattttagtctagatagtctaagataatgaagacaataacttccttcagtaaatcttatattcttttgtcaaatttttaggaaaaggattactcatttgcatacgtctactctcctctcccacacattacaaagggtataaatacaaattactactttttatgttctaatgcctgggtggcaaagtgagtcattctagccaatgactttaaagtgaaagtgagccaaggttctttctgaacaggtttattcttttctgagtgtcaatttttagttgtttttcaaaagaatatgtaaaatatcagtacctaaataaattttttaaagtagttcctaggatttttattttcacagagttaaacagttaactcagtggacagtgtatcccccgcatattatgaagcagaagcatacttgagtgtcagtgaaatcagaacccaaacaatgtccagtggcacttaccatatttagagctcttaaactatttaataagtaactacgtctgttgtggaactgatatgtagtagtagcctgagtgacatggagaaagctaacattcctttttttgaaagtgtttttttaatttttaaatttttattttagtccctgctgcccatttctctaccaccactcttaatgtttacaaatggcaaagctccagcgtggacaacatagtaagaccccatctctacaaaaaaaaaaaattttttttaattagctgggcatggtggcacacacctgtggtcacagctactcaggaggctgaggtgggaatatcgtttgagcctgagaggttgaggctgcagtgagctgtgattggaccactgcattccagcctgggtgacagaatgagtgcctgtctccaaaaaaaaaataaataaagaaataaaaaggcaaagtaaatgttcaacttgtgtgactatttatatgtacattttgtaatattcagtctacctaaaaacaatcatgttctgaaattctcatgatttggtatttaattgttggtgttcactcatatcacctctttatttttattttttattttttttgccgtggagtttcactcttgtcgcccaagctggagtgcaatggcatgatctcggctcactgcaacctccgcctcctgggttcaagtgagtctcctacctcagcttcctgagtagctgggattacaggcatgcaccaccacgcccagcttatttttgtatttttagtagagatggggtttcaccatgttggccaggatggtctctatctcttgacctcgtgatctgcctgccttggcctcctaaagtgctgagattccaggcgtgagccactgcacccggcctcacttctttaattaaagtggaaaactgtagcatatgctgaaatatatttgtactatggaagtgttagaatatgatttccattgcttctgaattagacctattcgaggtcctaaacatcttttttacagcatttcctttcttaaccaactccacttaactggcttgccagaagaatagtgctctttttcttctgtaaaacatactatcgcccatagcgtgttgaatagtttggctaatctcctagcggctagtctccccaggcttcctgctttctctcagagagttgtatgcattccaagagtcagtagtgaatgttcccaaatcataaatgccagttgaacctatgttataattattcatttaattatgatataattatgaagaaatttaagtgtgaaagagttattctatactatagttgataaaagcaagtcattttcttagttgctactgaacggatataggtgagtcagtggaaaagtaatagtaatataatttaaaaaggattctatacacaaatttctttcaaagtgcctttacagcttgcttcattttggagaaacttaaattaaaacccttctatcattaactgccttttttaaaaaaattaaattaccaagaacaagtacttctgattgcatcagataagaaggctatagttttgaaaactgttattggctatattgggtacgtttatgaagaagctatagtaaatataatatcaaaagcttcacagcttggcatcttctgcaggactttatttagcagcagaaagcccctctgctatcatctatcagtctctccatgttccatagcctaaagatacatatttgtcccctaatctatgatgatggaatggtatgatagactatttaagaatatgttactgttttattttaaactgaaatgtatatttttctgcattctacagtcaccttaaccagaaaacccagtttgaaaatccagtggaggaagccaaaaggaaaaagcagttaggacaggttgaaattgggtcttcaaaaccaggtaagcattcttttcaatcttttcttctaagaataacttgtgaaatttgtatgctgagttaataaaagtgagtttgaacttcttatttctatggctttgacactaaagagtgtctagttgttactgtaaagatatgaataatcttaataaaacatctgaacattatcagaatactgagatttttctcaggagtatacaaaaagcatgaagttgttgggagaagggatttcggcagcttttttatgaatttgagattttgttttgaagattggaatgtttccttatgtttaaggctagaccaatattaggtctccagttcatcgttagcttttcccaagttaattgcttaagtatggtatctgtaaccactgaggattcttcattaaccaatattaataaatactaaatatatcaaatgatttacctacatcattgagtctcaaatgggatggtagctattagtaacatcagattcatttagggagcatttttttaaaaatatagatccagaaatttcgatgagtctaatcatgtgtattttgaaaacactgctcaggaagttcttacattctacttatccctccccatcccttttccagccctcatttgtcattaataaccaggggtatatatggccatattgtagtaatccagtagattctccacttcggttgcctatgagagaaatagttctttcttatagttactcttcaaaaacatcgtcctcctcctaaagttctgcatttcgtttagcaaacattttgagtttaacaaatacttttgagcactgactatatccccagtgctttgctaggctctaggtattcaaaaatgactaagagtaagacagggcttgccctcaagagttcatagtctaatacaggaaactgatggttataatacatggagataggtgccatcatagagtagtagttataatggtaagctgaggagcaggtttgaatcccagctgtgtaatcttgggtacgtttcctaaatctctaaatgctcctatttcttcatatataaagtaggaataataatggtacccaccttttaaggtggttatgagtatgtaaattaacagatgtaaagtgcctacaatggtattaagcacatgttgactaataaatgatagtttcattgttattaatagacatgtacaagttacagtggtggcataaagacgggagtacccaactctgctttggtgggaaatgtcaagtgggcaggagaaatttcaaagcagaagagatagaaactaggtcttgaaaagtcaggaaaagttaaagcaggcagacaaaaattttaaaggagcaagaaagcataccaagtagaaggaacagaatgtttaaaatcacagaagcatgaaatggtgtgccgaaaggccagaaggcaagtaggtgtggttacagcatagggtatttgtagggtagtaacaagcgatgaggttgtagggataggcagccatgagaagaggttgagtatgtcatatgttgctggaatgtcaaggaagttgaagattgaaaaatatgtgttggatttgacagtagggaggtcattagtcactctaggaagagcaagtagagagtgaagtaaaattgcaatagaatgaagagggtatgggaggtcagacagtacaactgttggcaaaatgataaacataattaccatatatttatagtaactgctggaattccactcagtgtatacccaagatgaatgaaaatatgtccacacaaaaccttgtgagtgttcatatcaacattattcataatagccaaaaagtggaaataacccaaatgtccatcaactaatgaatggatcaacaaaatgtgttgtttatccatacagtgccatattatttggcaataatataataaatatattttatctttagtaagtacatatttaatttaatatttattatatattaataataaagagcaataaagtactgacatatgctacaatacagatgaccctcaaaaacactgtcaagtgaaagaaaccattcaaaaaaccacatattgtctgattttgtttatatgaaatgcctatattgggcacatctatacatggatagtagattcgtggtttcctaaggctaggatatggatgtgggttggggagaaattggataatgactgctaatgggcatggggatttcctctgaggagggaagaaaatgttctaaaattagattatgctgatagtcgcatgacattgaattgtacacttgaaagggctaaattctatggtatgtgaattatatctcaataaatttgttaaaaaatagataatggcagaacatttaaaatcttttttacagttaatttaatacttcataaattataaacctgcacaatttgattctctcagtttttgtcactttcctaatggcaggcatggttgaggagaagagagaagaggttctggaaggaagttgttatttgcagatgtgaatcactagggtcatctaacccctaataatgggcatttcaaaagaactatgtatttttttttcctaaattatccactaaacatgagtgaaagggatagaaatatgaagctatttactgatagtaaaaagattcactccttccatcagttataaatcaaagactgcagaaagcctgagctgtgaattataaaaattctcaatatactctctttcataagtttgtgacacttgacttcatcttcctggtatagtactttgcacataaaactcagtagatgctgagttttatagtacagttgaatagtatccaaactttcagaaattgagtgctaaaggttgtatcattttgacttcatataatggactctgggttgaaagtaagcacagacaaggcaatgagaaagagattaagttgagaataacattaaaaagtcatataaaagattgactctgagtgctatattcattgtaattatttttgttctcaaacccacttctcattttggcacagatatggaaaaatcacacttcacaagagatccatcccagcttaaaggtgtccttgttcgagcatcactgaaaaaaagcacaatgggatttggttttactattattggtggagatagacctgatgagttcctacaagtgaaaaatgtgctgaaagatggtcccgcagctcaggatgggaaaattgcaccaggtaagaaatttttcataattatttgaagagtagtgatactataacaaaaattatagtgaagagattttatatacataaagagagagaaataattaaattatataactaaagaaagagattccagtattaaaatagtttatactttaatttaaaaaaaagttgtatgggtatacagtaggtatatatatttatgggatacatgagatattatactatgatacaggcatgcaataagtaataaccacatcatagaaaatgtggtatacatctcctcaagcatttatctgttgtgttataaacaacccgtttatactcttttagttataaaatatacaattaaattattgctgactgtagtcaccctattgtgttatcaaaaactaggtcttattcattccttctagctatatatatatatacacacacatatatataatacacatatatatacacacacatacacacacacacacacacacacacacacacacacatatatatatttttttttgagacggagtcttgctctgtcgcccaggctggagtgcagtggcgcgatctcggctcactgcaaactccgtctcccgggttcacgccattctcctgcctcagcctcccgagtagctgggactacaggcgcccgccaccacgcctggctaattttttgtatttttagtagagacgaggtttcaccatgttagccaggatggtctggatctcctgacctcgtgatccgcctgccttggcctcccaaagtgctgagattacagacgtgagccacaccgcacccggcctttctagctatatattttttatattccttaaccatctccacttccctctcaccgccccaccaaccctaactacccttcccagcctctggtaatcatccttctactctctagctccattagttcagttgttttaatttttagcatccacaaagaaatgagagcattcaaagtttgtgtttctttgcctgacttatttcacttaacataatgatcttcagttccatctgtgtcattgcaaatgacaagatctcattctttttatggctgaatagtactccattgtgtatatgtaccatgttttctttatctaattatctgtcgatggacatttaggtggcttctaaatcttggctattgtgaaaagtgctgtaacaaacatgggagtgcagatatctcttcaatatactgatttcctttcttgtgggtatatactcagcagtgggattgctagatcgtatggtatctctatttttagtgttttgagaatcctccaaattgttttccatagtggttgtgcaaatttacattcccagcaacagtgtatgagggttcccttttcaccacaccctctccagcatttgttattgcctgtcttttggataaaagccatttttaaccagggcaagaagatacctcattgtgcttttgatttgtatttatctgatgatcaatgacctgagcacttattcatattgctgtttctatgtcttctatgtcttcttcatgagaaatgtctattccaatgttttgcccattttttaatcagattattagatttttcctatagagttgtttgagctccttatatattctggttattaatctcttgtgagatggatagtttgcaaagattttctcccattctgtgggctgtctcttcacttgactgattgtttcctttgctatgcagaagctttttaacttaatgtgatcccatttgtccatttttgctttagttgcctaggcttgtggagtatcactgaagaaatttttgcccagaccaatgtcctggagagtttccccaatgttttctttttttagttttacagtttgaagtcttagatttaagtctttaattcaccttgatttgatttttgtatacagcgagagatagaagtcaagtttcattcttctacatgtggatatccaattttcctagaaccattgaagagactatcttctccaatgtatgttcttggcacctttcttgaaaatgagttcattgtaggtgtatggatttttctattctgttccactggtctatgtgtctgtttttatgccaataccatcttcctttagttactatagctctgtagtataatttgaagtcaggtaatgtgattcctccagttgtgttctttttcctcaggctagctttggctattctgggtcttttgtggttccatataaatttcagaattgttttttctatttctgtgaagaatgtcattggtattttgatagagatttgatagagattgcattgaatctatagattggtttgggtagtattgaaaagaatattgattcttccaactatgaacatgaaatatcttttcattttttgtgtcctcttcagtttcttgcatcagcattttataatttttaatgcagagatctttcgcttctttggttaagttaattcctaggtatttaatcttatttgtggctattgtgaataggattacttttttatttctttttcagattgttcactggcatatagaaaggctactgatttttgtatgtcgcttttgtatcctgcaactttactgaatttatcagttctaatagtttttttatttgtggagttgttaagtttttccaaatataagatcccatcatctgcaaacaaggataatttgacttctccctttccaatttgtatgcctgttatttctttctcctgctgattgctttagctagaacttccagtcctgtgttgagtaacagtggtgaaagtgggcatcttcattttccagatctcagaggaaggactttcagtttttccctcattcagtgtgatactagctgtggctctgttgtatatatggcttttattatattgaggtatgtttcttatataaccagtttttttagggttttatcataaaggggtgttgaattttattaaattttttcagcatcagttgaaattattatagtttttttgtttttgttttgttttgttttgttttttagactgagtctctgtcacccaggctggagggcagtggcatgatctcagctcactgcaacccccacctcctgggttcaagtgattctcctgcttcagcctccagagtagctgggattacaggcactcaccagcacgcctggctaattttatatttttagtagagatggggtttcaccatgttagctaggctggtctcgaattcttgacctcaggtgatccatctgcttcaaatgattatagtttttatccttcattctgttgataccatgtatcacactgattatttgcatatattgtaccatccttgcattcctgggataaatcccacttggtcatgatgaatgttctttttaatgtattgtcaaattttacttgctaatattttgttgaggagttttacatcagtacttatcagaaatactggcctgtagttttcttttttttgatatgtctttgatttggatatcagggtaatactggcatcacagaatgagtttggaattattcttccctctatttttcagaatagtttgagtaggaattgtattactcctttaaatgcttggtagaattcagcagtaaagccatcagatcctgggctttactttactgggagactattatggcttcaatcttgttgcttgtcattggtctgttcaggttttagatttctttgtggtttgatcttggtaagttgtgtgtgtctaggaatttatccatttcttctaggttttccaatttgttggcatatagttgctcataatagtctctaacaatcctttgaatttctgcagtatcagttgtaatgtctcctgtttcatctctgattttatttacttggatcttacctctttttttctgttagtctaaggtttgttaattgtatcttttcaaaaaaccaactttttgtttctttgatcttttgtgttgttttcttcatttcaaattcatttatttctactctttctgcttttcttctattaatctagagcttagttttctcttttctagttcttcaagatgcatcatgaggttatttatttgaagtttttctttttttatatatataggcacttatagctataaatttccctcttagtactgcttttgctgtatcccataggttttggtgtgttttgtttccattattatttgtttcaagaaatttttccaatttccttcttaattcctttattgactcactggtcattcaggaacctattgtttaatttccatgggtttgtatagtttccaaaattccccttgttattaatttctgattttattccatagcagttgagaagatacttgatataattttaattttttggaatgttttaagacttgttctgtaacctaacatatggtctatccttgaatgatgccgtgctgaggagaatatatattctgcagccattggatgaaatgttctgtaaatatctattaggtccatgtagtctatagtgcagattaggtctgatgtttccttgttgattttctgtctggaagatctaatgctgaaagtgggatgttgaagtctcctgctattattgtattgaggtctatttctctctccttagctctaataatatatatcatatattatataataattatatatataaaatatataattgtaatatatgataaaatacctctctctttagctctagtaaagcaagtaacacttgctttatgtgtctgggtactccagtgttggatgcatatacatttacaattgttatatcctcttgctgaattgacccctttattattatataatgacctttttgtctcttcttgcagtttttgtcttataatctattttgtctgatataaatgtagctactgctactgttttttggttttcactggcatggaatgtctttttccagtcctttatttccattctatgtgtacctttacaggtgacatatgtttcttctaggcaatagatcatcaggtcttgctttttttattcactcatcttctctatgtcttttgattggagagtttagtccatatggattgagtgttattaatgatcagtaaggacttactcctgccattttgttatttgttttctggttgttttgtgattgtctcttccttatttccttccttccttttagtgaaggtgattttatctgtggtatgatttaatttcttgctttttattttcttgtgtatccattgtatttttttatttgagtttaccaggacgctagaaaatactatattataactcataattataaactgaggacaaattaacactgattgtataaacaaagaagcaaacaagcaaaaagaaaatgaataaaaactgtacaatttaacttcatcccttccttttaaattttttgttatttctctttatgtcttattgtactttgtcttgaagatttgttctagttattattttgattggttcattgtttagtctttctacctaagagtatgttacccaccacaattacagtttaatattctatgtttttctgtgtgctattaccagtgagttttgtaccttcagatgatttcttattgctcgttaatgtccttttctttcgcattgaagaaccccctttagcatttcttgtaggagagatctagtgttcacgaaatcccttagcttttgttgtctggaaggtctttatttctccttcatgcttacaggatatttttgccagatacactattatagagtaaaaggtttttttcctaagcactttaaatatgtcatgccactctctcctgccctgtaaggtttccactggaaagtctgctgttagacatattggagctcctttgtatgttacttgtttcttttctcttgctgctcttaggatcctttctttatctttgacctttgggagtttgatttttaaatgccatgaggtagtctcctttgggttaaatctgcttggtgctctataaccttcatgtgcttgaatattggtatctttctctaggtttgggaagttctctgatattatccctttgaataaactttttacctcattttttctgtacctcctcttttgggccaataactcttagaattgcccttttgaggctgttttctagatactgtaggtgtgctttattgttctttattcttgtttttttttgtctcctctgactgtgtattttcaaataggctgtcttcaagctcactaattatttcttctacttgatcgattctgctgttaagagactctgatgcattgtttagcatgtcagttgtatttttcaactctagatttctgtttgattctttttaattatttcagtctctgttaaatttatgtgacaggattctgcatttcttctctctgttatcttgattttttgttgttgttttctcaaaacaactatttttaattttctatctgaaaggtcacatatctctgtttctccaggattggtccctagtgccttatttagttcatttggtgaggtcatgttttcctggatggtcttgatccttatagatgtttgttggtgtctgggcattgaagagttaggcatttattgtagtttttgcaggctgggtttctttgtgcccatccttgggaaggctttccaggtattcgaagggacctaggtcctaaacccaataacaataagtaccaccttggtattcttggatacgattcagaagaattatctggattaataggcagagactcttgttcttttcccttacattcttccaaacaaacaaagtcagtctccctctctctctctctctctctctctctctctctccctccctccctccctccctccctcactctctgtctctctctttctctctctctgtgctgagcctcttggaactgggggttgggggacataaacatccctgtggccaccaccactgggactgcgctgggtgagacatgaaaccagcacagcactggatcttgcccacagccagctgtaaccactacctggctgccacttaaattaactcaaggccctggagccctatgatcagcaggtggcaaagtgagctaggttcgtgtccctctcttcaggatggtgagtttccccaagccgcgagtggattcagagatatcgtctgggagctagggattgaagtcaaaaaccttagaaatttacctggtattctattctattctggctaagctggcattcaaaccacaagacagacagaattcttcccattcttcaccttccacagacagagaaacctctccctgtggccaccaacactggcccatgtgggtgtgtgggggtgttgccaggccactgctaatgctcacctaaagcacaaaggctcttcagtcagcttgtgatgaatgctgtcaggcctgggactcacccttcaggacagtgggctctcctctgatccagactaggtccagaaatgctgaccaagagcctaggcctggactcagggaccccgagagcctgcgtggtgctctaccctactgtggctgagctggtacctaagctgcacgacacagtcacctttacctttccccctacttttctcaagcagcagtctttcaccatagttaccacagcagggaatgtgctgggtcacgcctaaagccagcatgtctcagagcccagtatccgtggtgtatttattacctgggtattgctattggttattcagggcccaggggctcttgagcaggcaggtgatgaaacctgccaggtctctgctgtgacagggcagcactgagttcaatgaaaagtccatcagccactgtgctccccctctcacaatcacacagatttctccataccaggtggctgctaccgggagctaagggagaggtggcgtaagcactcccttagctgccctggctggtgtctcgtaggttgcagtcaggtgtctctgatcccagctcagcactaggacttgtctaggaattgcagtccttgtggcctagactgccactcatttcactcggggcccagagcactccagcccccagtggtgaggcttgctggaactcagtctccaatcactggaatgggcaattcccctatggctagggtcgacccaaatgctccctttgttggcatatgtcagctgagtacagcctggttctgctttcccttgtgacaggggagcactgagttcaatgcaaatcctgacaatcgctgtgctcaccctctcccaagcatgcaaattctcaccaccagtgcagggaggatgggggagtggtagcactggcaattccagactgcctttcctatcttcttcagtgtctctttcagtgatatgaagtccaaaccaggcactatgattgctcacctgctttttgtctcttgtaacggtacttttagtgtgtagttagttgttaaaatttggtgtttctgtgggggtagggggatgagtagtgtaggcttctatcccgccactttgctctgccctccgtcaccatctatcctctaaactaaatgcatattatctttgatggtgggccattttacaaacaggtgaaaactgttggagaaaacattaaatttattaatattttgaaatattttatataactttgagataatccttttgctgtataaaactaaagatttattaatcatctcagaaaaatatttgtttgattttcttgaattataaaggatacttttggagcaaacatttacctataaccttatttgaaaaaaaggtcctgtgtggtgtttatcatggtatcaaattattaaatcttgccgtttttcccaagtttgtttgcttccttaatcttactggttattaaattgaactcctatgttaagaattgtagacataacattaccatttttacaaagtagtgtaaacttgtcttttctatagtttcctaaagcctttacttggtaattgctggatattttaatatggctgggagtgtttgtggttcaggaacttggagaaggttgaagactagtttctgattgcggggggaagtttaagtattgttttccagaaagattttagtattaatactgaggttgctttttgcagtgtttgctagacttttctaatcctctgttatttcacataccgtgaaaatatggaccaacattcagatggttgaattgtcatagtattttttgatctctcatattatgctttcccattgaggtaacaaaaacttaaaacaggaaaacttaaaataatcaagttatacttgtaaagaaaattatttttttctactttattactttataaagttaacaaactttagagattaaaattaatagtaaggttcttttgttttcagttttgaccttttcaacattttatccatgaaacacatgtcttagctattgtgtatgctgtcaggatttcaaaatgtagtttcatatttgcctaatatgcttatctaatttgcatggcaatacaatatttccgtgaaaattctgggagctttaataccagattgagttttttaaaagccatcagaacaaattaaagcacctttgtttggcaataaccttttaaataatcatattcaaataaaagctaattgatgagacaacaggggccaaattttaagtcaagactgtattaaaaaatacccaactgatgaccgtcaactggtaatgattctacaaccaaaatagtcttactaatgtcaaatcaggaaagcaaaaccaacttttagagggatttattaagctgccttgtcagtgtcttcaataatgcattgtttgcttctgttgaattttttgttgcttgtttcaccttttgaaatctgatttatacatcaaattcaaaattgctggaaaaagaaggatactacaagaaaatacactcataaattaacatcattctaatcttcagttcaaaatttgtcaaactagaatgaatttttaaagtacattgttagcaatggcttttgttttgtttagttttttagttttttttttattattattatactttaagttttagagtacatgtacacaatgtgcaggttagttacatatgtatacatgtgacatgctggtgtgctgcacccattaactcgtcatttagcattaggtatatctcctaatgctatccctcccccctccccccaccccacagcagtccccagagtgtgatgttccccttcctgtgtccatgtgttctcattcttcacttcccacctatgagtgagaatatgcagtgtttggttttttgttcttgtgatattttactgagcatgatgatttccaatttcatccatgtccctacaaaggacatgaactcatcatttttttttttttttttttttttttttttttttttttttttgagacggagtctcgctctgtcgcccaggctggagtgcagtggcgggatctagggttactgcaagctccgcctcccgggttcacgccattctcctgcctcagcctcccaagtagctgggactacaggcgcctgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagccgaactcatcattttttatggctgcatagtattccacggtgtatatgtgccacattttcttaatccagtctatcattgttggacatttgggttggttccaagtctttgctattgtgaatagtgccacaataaacatacttgtgcatgtgtctttatagcagcatgatctatagtcctttgggtatatacccagtaatgggatggctgggtcaaatggtatttctagttctagatccctgaggaatcaccacactgacttccacaagggttgaactagtttacagtcccaccaatggtgtaaaagtggtcctatttctccacatcctctccagcacctgttgtttcctgactttttaatgatcaccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttgtcttgtaaatttgtttgagttcattgtagattctggatattagcccttcgtcagatgagtagattgcaaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctaatccatcttgaattaatttttgtataaggtgtaaggaagggatccagtttcagctttctacatatggctagccagttttcccagcaccatttattacatagggaatcctttccccattgcttgtttttctcaggtttgtcgaagatcagatagttgtagatgtgcggcgttatttctgagggctctgttctgttccattgatctatatctctgttttggtaccagtaccatgctgttttggttactgtagccttgtagtaggttgaagtcaggtagtgtaatgcctccagctttgttcttttggcttaggattgacttggcaatgtgggcttttttttggttccatatgaactttaaagtagttttttccaattctgtgaagaaagtcattggtagcttgatggggatggcattgaatctataaattaccttggtcaatatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttatacattgattttgtatcctgagacttttggcttatcagcttaaggagattttgggctgagacaatggggttttctagatatacaatcatgtcatctgcaaacagggacaatttgagttcctcttttcctaattgaataccctttatttccttctcctgcctaactgccctggccagaacttccaacactatgttgaataggagtggtgagagagggcatccctgtcttggcgagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataaccatgtggtttttgtctttggttctgtttatatgctggattacatttactgatttgcgtatattgaaccagtcttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtgtcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattcgtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatccccttttatcattttttattgcatctatttgattcttctctcttttcttctttattagtcttgctagtggtcgatcaattttgttgatcctttcaaaaaaccagctcctggattcattaattttttgaagggttttttgtgtctctatttccttcagttctgttctgattttagttatttcttgccttctgctagcttttgaatgtgtttgctcttgcttttctagttcttttaattgtgatgttagggtgtcaattttggatctttcctgctttcttttgtgggcatttcatgctataaatttccctctacacactgctttgaatgtgtcccagagattctggtatgttgtgtctttcttcttgttggtttcaaagaacatctttatttctgtcttcatttcgttatgtacccagtagtcattcaggagcacgttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctggaaaaaatgtatattctgttgatttggggtggagagttctgtagatgtctattaggtctgcttggtgcagagctgagttcaattcctggatatccttgttgactttctgtctcgttgatctgtctaatgttgacagtggggtgttaaagtctcccattattattgtgtgggagtctaaatctctttgtaggtcactcaggacttgctttatgaatctgggtgctcctgtattgggtgcatatatatttaggatagtttgctcttcttgttgaattgatccctttaccattatgtaatggccttctttgtctcttttgatctttgttggtttaaagtctgttttatcagagactaggattgcaacccttgtcttttttttgttttccatttacttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttgatattattatgtgtgaatttgatcctgtcattatgatgttcgctggttattttgctcgttagttgatgcagtttcttcctagcctcgatggtctttacaatttggcatgattttgcagtggctggtaccagttgttcctttccatgtttagtgcttccttcaggagctcttttagggcaggcctggttgtgacaaaatctctcagcatttgcttgtctgtaaaggattttatttctccttcacttatgaagtttagtttggctggatatgaagttctgggttgataattcttttctttaagaatgttgaatatcggcccccactctcttctggcttgtagagtttctgccaagagatccactgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtatttcctgaatttgaatgttggcctgccttgctaggttggggaagttctgctggataatatcctgcggagtgttttccaacttggttccattctccccatcactttcaggtacaccaatcagatgtagatttggtcttttcacatagtcccatatttcttggaggctttgttcatttctttttattcttttttctctaaacttcccttctcgcttcatttcattcatttcatcttccatcactgataccctttctttcagttgatcgcatcggctcctgaggcttctgcattcctcacgtagttctcgagccttggctttcagctccatcagctcctttaagcacttctctgtattggttattctagttatacattcgtctaaatttttttcaaagtttttaacttctttgcctttgatttgaatttcttcctgtagctcggagtagtttgatcgtctgaagccttcttctctcaactcgtcaaagtcattctccatccagctttgttccgttgctggtgaggaactgcgttcctttggaagaggagaggcgctctgctttttagagtttccagtttttctgctctgttctttccccctctttgtggttttatcttcttttgttctttgatgatggtgatgtacagatgggtttttggtgtggatgtcctttctgtttgttagttttccttctaacagacaggaccctcagctgcaagtctgttggagtttgctagaggtccactccctaccctgtttgcccgggtaccagcagcggtagctgcacagcagcggattttcgtgaaccgtgaatgctgctgtctgatcgttcctctggaagttttttctcagaggagtacccggtcatgtgaggtgtcagtctgcccctactggggggtgcctcccagttaggctgctcaggggtcaggggtcagggacccacttgaggaggcagtctgcctgttctcagatctccagctgcgtgctaggagaaccactgctctcctcaaagctgtcagacagggacatttaagtctgcagaggttactgctgtctttttgtttgtctgtgccccgcccccagaggtggagcctacagaggcaggcaggcctccttgagctgtggtgggctccacccagttcgagcttcccggctgctttgtttacctaagcaagcctgggcaatggcgggcgcccctcccccagcctcactgccgccttgcagtttgatctcagactgctgtgctagcaatcagtgagactccgtgggcgtaggaccctccgagccaggtgcggcatataatctcctggtgcgccgttttttaagcccatcagaaaagcgcagtattcgggtgggagtgacccaattttccaggtgccgtctgtcacccctttctttgactaggaaagggaactccctgaccccttgcacttcccgagtgaggcaatgcctcgccctgcttcagctcgcacacggtgcgctgcacccactatcctgcacccactgtctggcactccctagtgagatgaacccggtacctcagatggaaatgcagaaatcacccatcttctgcgtcgctcacgctgggaactgtagaccggagctgttcctattcggccatctcggctcccacctgtttagtttttttgtttgtttgttcgtttgtttgagaccaaatctcactcttgtcatccaggctggagtgcgatggcagaatctcggctcattgcaacctccgcctcctgcgttcaagtgattctcctgcctcagcttcctaagtacctgggattacaggcgcacgccaccatgcctggctaattttttttctttttttgagatggagttttactcttgttgcccaggctggagtgcagtgctgcgacctcggcttactgcaacctctgcctcctgggttcaagcaattctcctgcctcagcctcctgagtagctgggattatagcacataccaccacacccagctaattttttgtatttttagtggagacagggtttcatcatgttggccaggctggtcttgaactcctgacctcaggtgatccacctgcctcagcctcccaaagtgcggggattacaggcgtgagccaccgcgtctggcctaatttttttgtattttagtagagatggggtttcgccatgttagccaggctggtgtcgaattcctgacctcaggtgtactgggattacaggcatgagccgctgcgcctggcctgagccaccacgcccagccagtggcttcttaaactcaagaaataaggtggtatttaaagatagactgaccctgtcaaaaagtggacaaaggatatgaacagatacttctcaaaaaaagacaattatgtggctaacaagcatatgaaaaaaagctcaacatcgctgattattaaagaaatgcaaatcaaaatgacagtgagatatcatcttacgccagtcagaatggtgattattaaaaaatcaagaaacaatagatgctggcaaggctgtggagaaacaggaacgcttttacactattggtgggagtataaattagttcaattaatgtggaagacagtgtagcaattccttaaggatcttgaaccagaaataccatttgatccagcaatcccattactggatatatacccaaaggaatataaatcattctactataaagacacatgcacacgtatgtttattgcagcactatttacaatagcaaagacaggaaccaacccaaatgcccatcaatgatagattgcataaggaaaatgtggtatatatacactatggaatactatgcagccataaaaaggaatgagatcatgtcctttgcagggacatagatgaagctggaagccatcatcctcagtaaactaacacagaaacggaaaaccaaacgctgcatgttcttataagtgggagttgaacaatgagaacacatggacacagggccgtgaacaacaaacaccagggccagtcgggggttgggggacgaggagagggagagcattaggacaaataactaatgcatgtggggcttaaaacctagatgacgggttgataggtgtagcaaaccaccatggcacacttatacctatgtaacaaatctacatattctgcacttgcatcctggaacttaaagtaaaatttaaatatatatatatttatatatgatatattttatatatcatatatataaatatatataatattaaatatatatatgatatataatatatatacactatatatgatatatataatatatatgatatataatatatatgatatatataatatatatgatatattatatatgatatatataatatatatgagatatatattatatatatgatatataaatatatatgagatatatattatatatatgatatataaatatatatgagatatatataaatctatatatatatcaggggtggaggaggatttctggctataggggctataggaacttgacaggattcttgctgaatgcaggctgaggtgatcaggtaatcacctggagaatggtggggaatgaggacttagatcatatatcaagagtgggtgattctggctaaaccaacttagcaggattcctgctaaagctgggctctggaggacatgccaaggatgaggcctactgaaaaaagagctcagaggaacctgtctagagtttggttaaggacagcgtctttttcagtgtatgtatatatacatacatacagatatataaataaaattaatttattcaaaaaatataatacagtttgtacaagtagtcagtggagttatttgcttctgtactaaatacctactgcaatgtgcctagctttgcatggatacttagatatgactcagagggtatactaacaatgataatataaattatcagggttttttttttaatgattcacttgagcttgaagtcaaaattctttgctactgaaataagtaggattttagacatttatacatacattttagagaggagttagaaaagggagaaggtctgtgttagaaatctatcttttcagcagttaatagaggtttccaaaattcaaatttagttgctaaattgtagttatttttgcccctctagcaaaaaaattaacttatttgttgattttaatatttttaacatgattatgtttttccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtaagtaaaagcacaacatagaaaaagtttcagtgttcaagcgtttatatctactgattgtctttccttacagtttagaatgtgttttcccagcagacttaactagtaattagtgtgcattttccttaaggttctgtctgattgtttccataagcagtgtctttttcagcagtttttaaaaaattattagtgatttcattcatgtccattatggatttatttccctctgtattcttttgaaaatctgattcatggctttaatgattagagagagtcacagcattgtgatacttcaaatgaaatacatcctcttaatttcatttctctgttgatgacagtaatagaaattgactctttcaaccaatggtgtgtcatctggacctctgtaatgcaccaaagatgttttgaaagagctagcatctctgtggataagtaaaatgttggatggtgtattaatctgttctgcagaggcaatcatgatagcatgtgctcataaagttttcatcttaagctctagtatctgactgtaaatgttaattaaaccacacagtgcttatgtgagagaaatataatttttattttccaaggtcatcagctgacatgaactcctcccagacatttacaaattcagttccaaggaataatcacaaagttgaattttaatatgctttcttaaatccatacttataagtgactagtatcttaaagaataaaagccacttactcttttatctctctggattttacttttcactattgaggcaaacgagcacttcagcttctttgggagttgtttcttattctcgtttctttgattcacatgggtttcttctctgagtgatggtggaatgtgctccaagtaaggtagaaatctctttgtgagtgcttgagagtaatccagggcttcaacaagtataacaaagacaccaaagttcaatgtcacacaggtttgatgtcagtttcctgccttgccacttactggttctttggtataggaaagaatcttagtttaccttctctgtaagatggtcataacatttgtgccttcagattgttataaaaatgaaatgagataatatatgtataatgcctggtacataggaggttagacacagaatttactagcgtactaaaagttgaagctagttttatcgtaaacattagcagtatttgtgatctgggaatgcatcctctggttttaaactttggttcattttttttttaaggtcctccttcaccaaccaaaactgccaaaatggtgagtatacactggtcctcaaatcttttccccaacacactgagagagatgccacattcccctctgtaagaggagctcactgtggtgatgattatcgactgggagaagttaggaggcatgctgcccttggcttgtatttattagaaactagggaagcgtttgaaaaagccccctagtgaggagatgtgctccactggttaagtattgcaactggaggattactaaaggcctattgtaccaataatcctgttctctaagttataaaatgtgaacacattaaagaaccaacctagaggtctttttacttttgtgtttcagagaaacaaggtaggaaggacctaaatgttaagacagatgataaactattacatcgtcttgcccctgcctgaagagaagacgtactagttcacataattttgtggggactataaatatgcatgcacctttagataatcttcttacttttaagactaaattaggcttatttttttattatttattttttatttatttatttattttttgagacggagtcttgctctgtcgcccaggctggagtgcagtggcgctatctcggctcactgcaacctccgcctccggggttcaagcgattctcctgcctcagcctcccaagtagctgggactacaggtgcacgccaccacacccagctaatttttttgtatttttagtagagacagggtttcaccatgttggctaggatggtctcaatctcttgacctcatgatctgcccgcctcggcctcccaaagtgctgggattacaggcatgatacaccacgtccggctgactaaacaagactttctagagtaattgtggccttctatgctaaatttgcttgttgtcaaagtgaaagacctgaaacagtgtcttctttggcattcttctaaataatcacgtagcctgtttaaggacctgtgcagagaataagaactttaaaaaggagtgcatcaaatgctgctgttgtggaagaaactctacaaggtgcacatttgtagctatttaaatatccacaatgttttggatataaagacaattttatttaaaattctaatttagttctagtttgctcctttggagtcttttatctcaaaatcaaaagatggccttccataaccataaactatagacaattatattaaatgaattagttctttctagcccaccaagtaggaatcctctgcaaatttgctgttttatagattaaaaagaatccctcagcttctggccttttttttttttttttttttgagacagagtctcactccatcacccaggctggaatgcagtggtgtgattttggctcactgcagcctctgccgcctaggttcaagcaattcttgtgccttagcctcccagtagctggaattacaggtgcacgccaccacacgcagctaatttttatatttttggtagagatggagtttcactacattggctaggctggtctcaaattcctgacctcaggtgatctgcccacctcggcctcccaaagtgctgggattacaggcatgagccactgcgcccggccagcttctgcccttttcattgactgcttatactacttgggtccagtgtgaacagaaattgtttttgtccattcagttcaaattgcactgtattctacatttctctggttcctctagtaatcatttttaactcctgtgccaccatatttatttcataatggatgccactgcagtcgcagtggccctaatgctttataattgatggaagggtctgatgaactttaaccgcctctgacagaatgctaagatgtatggggaagggtaggagactactgttagcttctctgccttctcattgggtctgggtgattgaagggtcccctctagcacgacactttgtagtggctgacccctgattactccctgacagactggtgcccctgcattctagtcattgttaatgatcacaaacatccataatctccctctcctaacaataatccaggaaaacgagctggtctcaaaaccatatttcttaggccatttattggatttcattgttaacattttattaaataagtcattttgcttggctgttatcttgggaaagttctagctgaataggaaaaatatcaaaatatgctactatgctttcccttatctaattgtcttgcatggtacattttctcttaatatatgtgaattggccagacagggttttcacagtgccatctttataacctaaattagagttaacctctcctgttttcttagaaagagtattatcttaaacatcttccttagaaattaaactcagtgaatgggaggtgggccgtgctaagaattttatgaagatattctctgaatctccctcttactttacttagaagtgctgccttgtattgtatttctatttatcttcatctcaaagtcaatttgtgtcttggtggtggagaaaagggcaaaattgtttaaacataggactaactaaggctcttcagttgatattactataaacttttttctaatttaagttaaatatgtttcaaccaaatacacattgctatgaaaatgaattcctgtaactgtaaatctgctgtgtctttgatcctgccacctatacaactataatcagttgacatatccatttcagatatcagttttatgaattaatcaaccatctgctttttaaaaaatactaagtaaggctcttttccatttcagaaaacagataaaaaggaaaatgcaggaagtttggaggccataaatgagcctattcctcagcctatgccttttccaccgagcattatcaggtcaggatccccaaaattggatccttctgaggtctacctgaaatctaagactttatatgaagataaacgtaagtagttgtggaatatttcaggagagcatataacaagataaatttggatttattttagactaggaccttcccatctttcagaagcatattgaaaagttattccttcattaccattttaatagaactctggacttcttccatgtatattcgacattcacacattcatttttttcaaaatcatgctttaagtgctagttatctaccagatgccatactaggtaaccagaatacagagataaataggttacataggacctgcacccaaaaatattattagaactaaatggaaaaagacaaatatgtaatcaaatagtatacaaataagtacacataataagcctaacaggtacagtgatagaaagatgaaatggataaattgggatccaaagaaggaatattcagttttatcagtgtgggcagtaggaagtgtcaggaaaagcttcatactggaagcaaagctttaactaagtcatcagggatgaaaaagtgtctttgaggaagataaaagggaaagatagaaggaatagcacatgcacactggccttgcatgacttgggctctgcaagtagttcactttcgctgggtgcaattggcaaggaaagtcacagaggagagcaggaacagattgaggaaggccaatgatgcccttccaagggagctggagttggtcatataaataacagagaaccacagaatgcctttaactataaggaaggcatagttttgtgttttagaaaggtttttctggcaggagtatgaaggatgaatcagaggtgtatgcaatttgagggagggtgtgcaatttgaagaagaaactaaagagttgactccttacaggagtccagctgagagataaaaagagagactgcataaggcagaaattcatgcatgttcctactaattcacttactaatgataaatcttttccaaagtaaaattgcagatttgagtaggtataattttttaaaatttatttgttcttagaaagagatgtaaatctaccttggaaaagatatgtacaagtggaatatatgtatagttgacttaatgcttatttaactagttgcagaagtacatcttgataatcccaagccatattcagaaagatgaaaaccagttgtacgcccagcaaagcaataatttaaattagcataacaatgtagaatccctttcttcatactttccattcatagcctgatacattattaatactggtataaactctgcagtcccatcaggcttcacccataaaataagtgagttgaactgatgactctttttttttttttcccctgagacagagtcttgctctgtcacccggagctggagtgcagtggcacaatctcagctcactgaaacctctgcctcctaggttcaagcaattctcctgcctcagcctcctgagtagctggcactacaggcgtatgccaccatgactggctaagttttgcatttttagtagagacggggtttcaccatgttagtcaagctggtctcaaactcctgacctcgtgatccgcccacctcggcctcccaaagtggactcttttaatctctaaagttctacaattttaataggaagtatatatcaaaagatactgcttctatagaatattatcaggaatttactaatctcactttttacatagttccctgacatgtttatttcttctctctttacagtaaatacttcttacctataaataacattaatattttcccaaaggaaaaattttagtcatgaaatagatttttgtgacttaatattctttttttttttttttgagatggagtcttgctctgttgcccaggctggaatgcagtggcacgatctcagttcactgcaacctctgcctcccaggttcaagcaatcctcctgcttaatattctaaggaatacaacctaccctttgagggtaggacagtatgagttaggagattagaccctggaaatcaacctggatttaaatcttagcttcaccacttgctatgtgacaatggccaacttacttacaccctcagttttcccacctagaaaatggggctaataataaatgttagctcttaattattttcctttaaaatgctatcattttgcaaaactaggctaggtaagtagttcatatggaatacttttctgagagaaaggtattagcttgagagcaggaataaggtattttacaggcactctatacagcagtgcctgtacagatttaatgtaccttacccaagtgttaacttaggtcatttgcacctgtcaaatatcaaactcaagtttgatcattctgaattcaacattgttatattgattggacagcattagaagttaatggcagtgtaatactgagtatatggaagtgagagtaaatgtttctaaacagtcttcatacagttttgtttagagctcaaaacgaggatttatagttgaattgtgtgtgtgtgttacactcttgtgcaaattttccatattaaaaagttctgagattatagtttattgagttactctataatatcctactaaatactgaactttgttttgttttaatccttttaaaataaatcatagtatttatattttctgattttcctcagcaccaaacaccaaagatttggatgtttttcttcgaaaacaagagtcagggtttggcttcagggtgctaggaggagatggacctgaccagtctgtaagtgtcacttctttggaacatggctgtttcctgttcaaacgttttgagtggtgatttggtggattatggtgtgttttaagtttttttttctctgacagtttcattaatatgaagaataactgcatttccattattatcatagtccctcagttattgtggtgtagctgaggctaaaaactgtgggtaaaaactgaatatgtcagctgcaaattagacagtgattaatttatttacttctctgtgtgaataactacataaagcttattttaagtttatattttcctttgccctcattaaacagagtctaagacattttccttctctaagaagcctataatcccatgtcctctttcccactattactctatcttctggatgctccataaatggttggcatgagcctgtgcatattgtttcacctcgtcttattaataggttggcattttcatgctcagtactttgcatgtcatttcatctgttacctttgaaactagaggaatataaaataattaatatttttgtccagaggcataagggttatatttgcaaagcatttgaagtctaggattttgtttacacatgattctcacataaacttgttttagagaacaaatgtagtgggttttgtttctaagttttgctcttggtttgaataacaaagaagtaatgtgttctgtagcatttttaagaacatatttgcattttattttatataatatcaatatattatatatcaaaaaatatggttggaagttaggtgaagaacaataatctttaaaaattacaggcttcttatttctgaatagaacatttgatttatgtagtataaatttgttctaattggtcatattggttacagttacaacagtcattggagacacataaagcttaaggcaggttgccctatgtagaacaaatactagatactttaattgttcttggtatttgtatttttgttttattgcttcctattttgttgatactcataatgttcacttagacattttaagaatttgtctcaaacaacttagaagaaacctttcttttctcttaaatgtcagattttagcagctctgaaactagcctaaacattcaggattgcctaattacaggattctaatgctggtgagcaaaatgaaccagatttgttcacctagatgcaagtgaagcttcaggccactctgttcccgctgagatttagaaacaagaaatgtctctgtgctgtgtatattgaacttgtaccgttagtcatatgtgatgggagtactgttgagaatgatcccagttgctgtgaacagtatgtagaaaatcttgcctgatgacattgaacagacttttaatagctactctgcagatttatattttctgagtttagtgttttgtttcattgtaatgatagggataatggttgtgctttttgagttatcgaacaactttgtattttctattttctttgtacacagccctgaggatctataagggattacataatacaatgtggttatttgaagtgccattttggagaatgggcactttctcagataatacctttctaaaatataactgttttcatagttgaactgcaaaaatctgttggtttgcacaatgctaagttaggaattccttaactcttcagctaaactttacactgtggaccaaactgtactttgttatcttatcagatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggaggtgtgtgaacttgttcctgctctgaaaagttaaaaaagaaacaaagatactagtctacttcctgtgtagttttgcaggttattttattacattcagtagtatctaagataacccatttggtgtgatccagggcctcactgtggaaggctatgcaaacacaaaaggattcagaaataatactactataaaaaaataaattttgggcttctatattaagattattttcatatattgatgcattttgcaaatgtattataggtgggagtattgatttaaatccggttttgttttgttttgttgagttgaggtagagtctcactctgtcacccaggctagagtgcagtggtatgagctcagctcactgcaacctccacctcttgggttcaagcgattctcctgcctcagcctcctgagtagctgggattacaggcacacaccaccacacggctaatttttgtatttttagtagagacggggtttcaccacattggccaggctggtctcgaactcttgacctcaagtgatccacctgtctcagactcccaaagtgctggaattacaggcgtgagccactgtgcccagcctaaatttgttttgtttttttttaaataacaaatacaaaattatttagtcataccaagatatcccactagctgaatatacaaagatttttggatcccagtgaaatctgagctactaaaggaaagtaggatgtttctacttgagaagttttagtataatttaacatttattgagtgcttactatgtcctagatgcatggattattttatttaatcttcacaacactatgaggtcattatctagttctatgattactcagagaaaggttgagaaacaaataactggtaagaggtagggcctggattaaaagttgcagtttaattcagagatcagggtttaaaccatagcattaggatatgaatatctcttatagtttctcgccagtagctttatgaataattaaatagaaattcttataagtgaattctttccactttaaaattaaaaaaatacaactctgtagcacaagaatataagcctcatgaaggtatgaatttttatttgtgtagttatctgctgtaagctcggcacctaaaagagtgcctgtctggtacaaagtggacattaataaatgttgttaattggatgaatatttacatcactcttaaaaatgaggcactgtattttttattgcaacattcaaagtaaaggcctgcctcctttggtaaataccaggcatttagaatgcatatagattgtaatgcagtactgcctcaatttggttgtgttggaggccaaatgtaactacttacagtaaaattgtgatgttatacaacctacgctcttccctggaaagaatcatgaagaagtttcatagtagtttggtattattggagacattttagctaatacattctaactatgcattttgaaaaaaaaaaagaaaaaaacatattcttaaaaccatgtgaattttcagccagaaagagaccttataaatatggacatgactgcagtgtgttgtggttattattaacgatggtttgtaccaaattatggcaaaaaatatgccctttttaaaaaatcagttaggactttgtgtcattctcaagttctgatgtcatccttgaagagcagaaaaaggtgtaggttaattggccatttgtcaggaatttcatatgaccctgtctatgcccagaagtgtttgctattcatgtggacagcttgttatgtgtcccagcaagttgaggggtggaggttggggaggttgaaggctgagaactgctaatgatgaactcatcttatatcatcactcaggaaactgcagttgcaaaacacatcatataagacaaatcctgtacaggtagcaaactgttataatggggcagcatttctgccctgatgctttaacctctaagacagacatcaatgaatatcagtcactgagctaaattatatttataattgattttaaaaggaagttcatgtgtcattcctcattatgtgtttcattaaaattattggtccatgttataaaacttgatggaactaaaacagttttaggaagaatttttttactatcaaatctcacagaaactttgaaaagcttcctttaaaatgagatcatgaggtcaggagttcgagaccagcctggccaatatggtgaaaccccatctcttctaaaaatacaaaaattagccgggcatggtggtgggcacctgtaatcccagctactcaggaggctgaggcaggagaatggcgtgaacccaggaagcagaggttgcaatgagccgagatcgcgccactgcactccagcctaggtgacagagcaagacgccatctcggggaaaaaaaaaaatgagataacatgagattgtatgtatttttcagtaatccactctgagtatttgggaagtcggatggactgctgttgcctacatctgcactcagattatacccgaagctcacatgtggggctgcttttctattctttatgttattagaaactgaatttttctgtgagaggcttagcataaaaacactttagtcaccagaaattatgatgttccagacatatcaaaactgatcatgtttattacagaaaaacaacccgaggacgacagctctcaggccttcatttcaacacagaatggatctccccgcctgaaccgggcagaggtcccagccaggcctgcaccccaggagccctatgatgttgtcttgcaacgaaaagaaaatgaaggatttggctttgtcatcctcacctccaaaaacaaaccacctccaggaggtaagggctattgtatcttattgtctctccctgcaagtccagttttctgaggctcccactggagtttatgaaataattaggagctatgtataaaatgccttaggtacttatctttttaagaatggtgaatactttccttattttcaaaattaggtaatttgaaccgaaccttccaggcttcaagtttatctattatctcacattctataaaatatttaataagtctcagtagctccatttgcctcaaggttatactgaagacagtatgtcatagatatggatttaatgaaaggtataatgctgacttttaagaaaatggggacataggttttgaaaattaggataaatcgtgtatgtagaaaatagagactagaagcaattgagaagaagcaaagcagattaacagaaaaatcttgacccaaatatgtcgtagatattttatgttattatttaataataattgccatagtccagctataaattacccttgttgaatgataagaggcataccttttataaatgtttcattgaaaggtaaaaattttgtcaacaattggaaaatggatctaaatatcttgaaccaagtttaacagaatattctaatccagaagatgaatgtatttatatcagttccatgatcaaaggaggaattacatctgatatattcagggctgttacgattcagcaaatgaaatatttgtcttgatatttctataaaataataatttttaatataattataaaatccagttgaatatgagaaccagctccaagtcaaataataaaaatctttgaccacatgaaaatgtgcccttgcctttacaagtcagtttgattatgttttgaatagtgagatccttttagaccaagtggttgctaaaaccttagtttaaaaaaaagaaaacacttttaggaaagtgttgtgagccaaatcagtttgcaaaaatcttgctaaaattaatggaaatgtataagggaaaaagagtccatgacatggatgagttattgctatagtattaggtcactgctcactgatgctagtttccattttcccaaagcagttgccatggaaacacttggaactggaactgtcactgatgctgtgaggatgataatatggcgtgtgtcagaaaaatgaaaggaaagcagcttttaggtggttttcatgttgtatcattggaatcagtatttccaaaaacagataaccatttaggataatgatattgtcattctcgtaacatacaataacaccaggcattcagattaactaaaacagtgaaagtattactctagtagatagatgctaaccactttctatattgaagatattccctttctagcactacagaaatttggggaaagtctagtgttcactataaaactaagctatatagaggaattcagtaaaataagtttcattgcttaaatatatttaagcatatttttacatttatttatatttaacatttatgttatattaaattttaatatattaagtatttttatttgtatatattggtaaatttttaaaaatttaaaaatctttaagtagttttatatttccttgtttcaatcattttttactattgtgatggttttacctatggagatacttcatctctttaagatagtgtcattaagtgttgtgttttgtaatccaacaaacttggattcaagtcctgcttatgtcttttaatagctgtctgatcttgggcaaattactttccctccaagagctccagtttcttccacaaaatgaggatgatagagacactccctgtctcatgaatgtgaggattaaaggagacagggtatgtgaagcccttagccaaggccttcagtaaatgttagctgctgttgcttgttgtaacttctgctgccattgttatcatcatcattatttagaaaattgtcaccgtctcttaacttttcttttaaaaaaaaacttttaaaagttcatcaatacttaataatgagataggaaagaaagcccaattaaaatgtaagattgaggcagcagctaacatgtggcaggagatgagtatttgcagctcattaattatcaggctgaatggtaaattaggctcaggttgttgatgaattttatgtaaagtacttgagattttcagtcatggtgtaaaaccagaattgataatttcactgaaatgctagttaataatctcataaaatgttgaggcctgagagtattcttgttagaattttatttttcacatatagacagaaaaagggtcctggggaaagctccaatgaggagttttcacttacagagactgaacacttgctgcaaactgtatgacagagaaggtttggttcagaaaggagttagcacaggtggaaaggcaggaaacctgtctcagaatagatcagtattttctttttcttttttttttttttgagacagtcttactctgttgcccaggctggagtggagtggtgtgatctcggttcactgcaacctctgcctcccaggttcaagtgattctcgtgcctcagcctcccgattagctgggattacaggcatgtgccaacacacctggctaattttttttgtatttttagcagagacggggttttgccatgttggccaggctggtctcaaactcccaacctcaggcaatccacccaccttggcctcccaaagtgctgggattacagacatgagccaccgtgcccagccagatcattctttatggacctcatctcaggtattttctgatgacgtatgtctcaagaagagttcctagtagcatctgtggtaccagttatggaattctgagtttctctactgttgactttttcaaagatcagggatccaggtctagcatcctcacaatttgtctaagtgctgaatgaatggagtacttagaaaaggcctctatttaagattaagaagactcggctagtttttgctttactagtacttcagagcttttagtgttattccttcttatcatgtagttttcagttctggttgcaaaggatttctttgaaaagggaacatttccagttactgttctttgttttcctgaaaagaaatgttttaagagcactaaagtgatctcaggatctagacaagccaggctatgagacagatttaggccaaagatgaatgaagatggataagttggctttatggcaaatgcctgtagactttgtgtatcaacaaaaacaaggcaggactgaaggcttttccctagctatgtgaactctaaggggttaccttgaacagtttcccagtccgtttagaaaatgttcagaagctacctttctactggtctgtttgctatttttaactgttccggtgacactgctataaatactaagacagtaacaatctgactgcttttaccttccctcacccagacaaccagccctttaggaagttgtataccaccatgcaccaattctttttaccacattgctcgcagactgagaaaggggaccactaagatttcagagattaattctatttaatgctttcccaagtctgaacaaactccttttagtgagccaaggaactgaatgattttcttctcagagtatctagaaagaacactatgtttgagtaaatcttttgtaaggagaataactgagatattgatttagaaggtcaccacagggccaccgtatgacctgccgtatgtttctggtgtgccacctgttgtagaattagtgaatcaactcataatgcctgatatgacatggccctttctgcactggcatttctctaattacgttgtttgtaaggaaaatagaataataagtgcttgacataattcagagctaaaaggcacttccttccaacattgacttactctattttaagataaaatctgccactgtgtattcctagaagagccagggcactgtctgtagggaaataaatcatcatcaagaataacttttctactccaaatgaaggtctatttaaatgtcccttacatactcctagatatgattcagaaatactagtaaggagcaggttttactatggaaattaaacatcattcacagtgccattcaaaaatatgaattatccctattcaaatcagtcagtagtcagcaggagcccacatacctgataagtttaaagtttactgacctaggctaggaaattctcagagaacatagaaggaacatttgtttcctaatacaaatgctgcctgttgcacggtggaaaatattttgtttgacaagatttcctgaatatctgagaactcatttcaagctataataatagcagagtatcttaatagttagtccaggaaggctcttagcattataagctagagatacagtagagctacacagagcatctttgcaattgtattagactcagctttgtgtatttggtttagaatttgatccatgagtcaagtagtcttaacagttaacatttaatgttccaattccactcagcttttcaaattttaaaaagagccaaaggcataaataagaggaattaatttacatgtggaattaagtatgattcattttaattgtcagtcatttcactgtacctgaatttctgaccaataactaccgagtgctaaacctgagtttgacctgcatttatttacaaggttccttatgggagcaagtgtccctttaacagaagcaaagataatcttatcgtagcagtttttaaaatagctaaaaacttgttgcagcttaaatggccaacaataaacaatgagacatctgatcagtcaggtggtatcagtgagattagtagctcttaaacagaacaattacgatgagaatgtaaaaattagaaaaaggtttctggtaggtagaaaatagcaaagaggtttatatgctatgattacaactgtgtaaagagtatttatgcatgtgggcaaaagtgagaagtatgaaaatagttccgtttggatgcgatgatgacgtgtggtacttttctgttatgtttttaaataattttctttgatgttatgttgaattttaaatgacgttgattataaatctaacactagcagaaatcttaaataattgaaaaacctggggttttttttcccatagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaaggtaaggagccagtagacgcgcctgccccaagctgatctgagaggcacaaagcctgtgtgaggcagtggcctcctccagcactgccagaatcactgcggggatataactgtgtatgcacgctggagtcttattcttccccttttcaatttaatgaacttaaaaaacaacttattataaagttgtcagcagctcaagaaaaataatccagctagtgagtgtggaccgtttatttatgtgctagagaagcaagcacccagaagtgaaagagactggtagtacttttcagatcttattttcttaaaataatgtcttaagtcttcgcttaagtgagagaaaatcctttaaacagttcaaagaaagtcactgttgatatcaagtcttttatgtcaggcccatgccacagtgtgcctttccttggggacagggctttgttctgggcagccgctttgtaaacagggtaaaggagtgcgtgggaatggctagtaagtggggcataaaacacatactggcagccgtggagtctcccaaacatgtttaatgtcttgccttgctgtaaagctgccttttgatcattaagaatttctaattaggaaccatctttagccagtccatattctttgtgaattacaacataaccactatgtaatgctctcatttttcctgattttgcaaaactaacaaggagaagccaaaaacagaattatgaagggtcagtctttgatgttaaaattcctcatactataatgtgtattcatgttccattttctcccatgaccctctaatctagttggtttccaagtcttttatacttcctggttctaccttttgtttctgttcctaccacaccactctcatcatttatttctaaggtattacataaatctgttcaagatgctataggggttatttctgcatggacatgaattgacttcactgctcccttaggccctgtcgaattctgggcaggattccaagatgctgtgacatccctgcctttgttctttcccttctccattctgttcctatactcttctcagactctgctgattcttttctaaaataatcccttgtagaagctccactgcttccccactctctgcccagaaagtgttctgtgattttgctctcagccttttaaatgtacttctcagtattctctccacaccctctctaagctgggcctcactggcctctatgtacatggccttcccccgcaaccgcaactcccatagcacctcctatctctgcacttcactggacatcattcttacataaccatatccctatttaaatggtctgctctttgtaaacaaaaaacatattggttgactatgatactagatgctcagcattttttttttttttttgagacagggtctcactctgttgcccaggctggagtgcagtggcacagtcctggctcgctgcagtctcaacctcccgggctcaagtgatcctctgacctcagcgtcctgagtagctaggactacataatttttaattttttttttttttttttttgagataggggtctcactgtgttgcgtagtctggtctcgaactcctgggctcaagcgatcttcctgcctcagcctcccacagtgctagtattacaggcgtgagccaccatgcctggccagcaaatattttttgaatgaaggaatgagtaaacgaatgagtgaacaaagtaaaagttaggagatgttagttctgagggcttctgtcccattacctaagcagaggctatttaaacccaataaaagaagtaaggcttttgacaaaggccacagatacctattagctagttacatgacaaaaaaactacataatatttctaatcttcacttttttaactgtagaactggagtagtaatatctatttcagtatcatcatcaggggttaaaggtgaaaatatacataaactgcataaataccctagggtgctcatctaatatcattattttacctacatgactggctccctcattcaggtctctgtttaaatctcacttcccaaggaaataataatagtatttaataagtgtgtactatgtgacaggcactgtcctaaatgcttgacatatattaactaatacaataatcctaggcaggcactatggttttccaattcttgtagatgaggaaactgagtcacagagcagttagatgaattgcctgtggttaaaaaatgttctaaatgcttactctcaatatctatgtatctcgtctatgaaccacactttgggtagccttgggatagattgttaggaaaaaaaactacttctttctccagtaacttttcccccaaaattactgtttaatgttgatggtattttctccaagagattatccaagattgttcataatttttcttagaataaaagttccctttcacattctggcccaaacacttgtggacagacacttaagatttcctgtgtaacgtcagtttgtgtgcagagaaaagagaagggtggagggaagctccctagaagatatatacttaaagtatatttcatatgcagccacagcctcttaaaatacagtcacattttatatgttaaatcacatttcactgatcacacactattttattatgctctaggttttttttaaactatgaaaacatccagaatctcttatttttcttaggaaaaaacagaaaatcttccttctgtccataaagatctcattcatggagtttgtaagccttccaggttctcataaaattcagtataaaatctatcaactgcattaatgagtcaaatgaatatttataactctaaagctattttcagaaaccacacattcagatcaataccttagggcagcagagcttcccatctgatacttctccccttctctccatcagccattccccattgacaggtaaaagacagttacctagaaaatgaacaactcttggtccctccatccttttttccccctttgctagatgctgtttaatatttgtgcctatgttgccaaggatatggtaaggcaagtgtcatatttcataaaagacttccaaactgtagccaggacttgagactgttctctatcatatggcattccccacaacactaccgcctcttcctctgccatggtatcttgtttttaaatatggaacataaatttactatatctggtagttcctgcttactgtaaaaaaaaacttaaattatataatttttcaaaattaatttcaaattttttgtcaggccttgttaattttaagagtgaacatgacttaccaaaggctaccaagcactcctgttggaattgattctggtagtgttgcaatacttttgttttgttttgttttcagttgatttatctgtttattcccatttgtctccattttccattctcatttctctcactgctcccattggcaagcattctagtatgttttatgtactgcattttatttgtacatcttttaaaatacattttttgttgtgtgttggcatttatttttgagttacgtaaatgttatggattttacactgggtttttctcagaaccatgttgttgttgttttcttttaatgccattttactgttctaagatccaatccagtattcctcttgacatttagctgttgtcttttttttctttttaattgggatagacttcatatactataaaattaatcattctaaaatatacaatttggcctggcgccgtggctcatgcctgtaatcccagcactttgggaggccaaggcaggcggatcaactgaggtcgggagttcaagaccaacctgaccaacatggagaaaccccacctctactaaaaatacaaaattagccaggcgtgatggcatgtgcctgtaatcccagctactcgggaggctgaggcaggagaatcacttgaacccgggaggcagaggttgctgtgagctgagattgcgccattgcactccagcctgggcaacaagagtgaaactccatctcaaaaacagaaatatatatatatatatatatatgcatttcagtggtttttagtatattcacagggttttgcaatcattaccactagttccacattttattgctccaaaaagaaacttcatacccattagaaatcacttcccattctctcgaaacccccatccctaggcaaccacttatccactttctgtctctgtggatttgctgggtatttcatataaatagaatcatacaatatgtggccttttgtgtctggcttctttcatctggcaaaatgttttcaaggtacgtcctagttgtagcatgcatcagtactgcattcctttttatgactaatgaacaatatttcattatgcatacatatatttttcttacctattaatcatttgatagacatttcagttgtttctactactgtgaataatgccactacaaatgctgttttataggtttttgtgttgttttatgatttcatttttcttggtcgtatacctaggagtggaattgttgggtcgcatggtaactatgtttagctttttgaagaacttcaaaactgttttccacagcagctgcacccttttatattcccaccagcaatgtatgaggcttccatttccccatatccttgccaacacttattttctgtttcaggggtttgttttctagccattctagtgggtatgaaatggtatttcattgtggttttgattggcattttgctgatgagtaatgatgttgaacatctttttcatgtgcttattgactatttgtaaatcttctttacatagagaaatgtctatttaaatcctttgccatttataactcagttatttgtcttttttattgttgaattgttttctgaatactagacctttatcagatacatggtttgcaagtatttttctcccattctccatttgtctttttactttcttgatactatcctttgatgcacaaagttttaatgctgaagaaatctaattcctctatttacaggggcggtgcttgtgctttggtatcatagcatcatatgcttttaagatttatctgcattgctgggtgaccataattgattgcttttaactgcttgaccgttttccatgagtatttaccacaaataacctgtccacttccctatagacagtcacattgcctacaacactacagtattacaaacaattctataatacacatcttcacatatctatgttacaaaacagtgtgagaagccaggcattggtggcacatgcttgtagtcccagctacacaggaggatcacttcagcccagaagtttaggccagcctagataacatagcaagaccttatctcttaaaaaaataaaaaaacagtgtgagaatttctgggagtgaaattacttgatcagagggtatacatgtatttgatttaatattgtcagattgttgcatccatctactcccaccagcaaaacattgaggattctgatactgtacttccccaccagtactttgtattatcagcttttgaatttgctagcctaaagcatgaaggtgttgtcttattatttaatttgcatttctctgattgcccatgaatttcagcatctcttcatatgcttgagtttttttcttgtgggatttctgtgttgttgatatttattggatactcatgaattatatggacttcagtagtacagttttgttttagagactataaatatctatctttttctgccatctgtatgttctttgaccatggtaccctttattatacagaaattcttaatttagatgtaatcaaatttgtcactttttacctacagcttaaactcttgaggttttatttaagataagtcattttttccccacatcacagagatttttcttttatatgatctaataccagatttgtaattttgatttttgtacttaggtctttaatccatctggagcctacctttgtatgtagttttaggagggatgtagttttattttttattcttaagatgagccagatttcccaacaccagctattagacagcacttctttgccttatttatttgtgatgccatctctcctatatatcaacttcccctttaaacatgagtctccaagtcctctattctgttctattagtttatttgttcttgggctgatgatatgtgtgtgtgtgtattttttatttttttatctgtaagtttgtgatacatcctaatatatctgcttattagggaaaacctatctgtctccctgtttctcaaaattgactacatattcatggaacttttctatataaaattttagaacaaattattaagctcctccaaaaaaaatcaaagtgcagttttttggggatatattgtgtatacgcgtatataaatatatatgtgtgtatgtatatatattttgggggtggagaatatctttacatattaagtcatctcaccaaagatcatggactgtatttccaattattcagctcatcttttatgtcctttaatagagttttagagttctagtatgttctctcatagggttcttatttactcttggtaaggtgagtctcaatagattataatgtttattgctgtagtttaactgtggattttgtttttatcttttgaaaatacactttcttttaagtgtattattataggcataccttggagatactgcaggttcagttataggccactgccattaggtagtgaatattgcaataaagtgaatcacatgaactttttggttttctagtgcatatagaagttatatttacactatactgtagtctcttaagtgtgcaatagcagtatgtcttaaaaaacaatatacataccttaatgaaagtatactttattgctaagaaatgctaatgatcatctgggcctttagtaagtcttaatctttatgctgatggagggtcttgcctcgatgttgatggttgctgactgatttgggtggtagttactgaaggttgaggtggctgtagcaatttcttaaaataagacaataaagtctgccacattgactctttctttcaccaaagatctctctgtagcatgtgatgctgtttgatagcattttacccacagtaaaacttctttcaaaattggactttgtcctctcaaactttgcctctactttatcaactaaggttatgtactattctaaatcctttgtggtcatttcaacagtgttcacagcatcttcaccaggagtagattccatctcaagaagccacttctttgctcatccgtaggaagcaaatcctcacctgttcaagttttgtcatgagattacagcaattcagtcccaacttcaggctctacttctaattctgttccttgctgtttctaccacatctgcagttacttcctccactgaagtcttgaacctctcaaagtcatccatgggaactagaatcaaattattccaaattcccgttaatgttgatatttttgacctcttccccatgaatcacgaatgttcttaatgtcgtctagaaacctttccaggttttcagtttgctttgcctagacccgtagaaaaatcactatctgtggcagctatagacttaccaaatatatttcttaaaatactaagacttgaaagtcaaaattactccttgatccatgggctacagaatggatgttgtattggaactcatgaaaacaacatttatctccttgtatttctccatcagagctcttgagtgactaggtgctttgtcagtaagcagtaatattttgaaaggaatctttttttctgagcagtaggtctcaacagtgggattaaattattcagtaaatcatgctgtaaacagatgtgctgtcatccaggctttattgttccatttttagagcataggcagagtagatttagcataattcttaagggccctaagatttttggagtgtaaatgagcacatgaatttaccagctgcattagcccctagcaagagagtcagctgcctttgaagctttgaagccaggcattgacttctcctttctagctatgaaagtcctagatggcatcttcttctaataagaggctgttttgtctaccttgaaaatctgttgtttagtgtagccaccttcaccaatgatattagttgaatcttctggaaaagttgctgcagcttctgtatcagcacttgctgcttcaccttgcagttttatattatagagatgacttctttccttaaacctcatgaaccagcttcttctagcttcacacttttcttctgcagcttcctcagctctcagaatggaagaaagttagggccttgctctggattaggctttggcttatggaaatactgtggctggtttgatcttctatccagaccactaaaactttctccatatccagcaataaggctgtttcattttcttgtcactcatttgttcactggagtaatatttacaattttcttcaagaacttttcttttgcattcacaacttggctaactggtacaagaggtctagctttcagcctgtctcaggtctcaacaagccttcctcactaagcttaatcaagtctagcttttgacgtaaagtgagagatatgcaactctttctttcacttgaatacatagaggtcattgtagggttattaattggcatgatcaatattgtgcatctcagggaatagaggggcctgaggagagggagaaagatggggaaaggctagttgatggagccagcacacacatatttatcgattatgtttgccattttatatgggtgtgatttgtggcacccaaaaacaattagagacaagtaacttgaaattgacatacccagtaagcaaaggtggaagacctgggaatttccagtgggtacaagaatataaatatcaaagatcactgaccacagatcaccataacagatataataataatgaaaaagttagaaattttggaagaattaccaaaatgtgacacagagacatgaaagtgagcacatgctgttggaaaaatggcactaatagactcgcccaatgcagggttgccataaaccttcaatttataaaaaatgcaataaaatgaagtgtactaaaataaggcatacctatacttacagacagaaagcccagcaaaaatgtaattctcatcgaaggagagatatacttaacccattgctttactattttaagaattttcaaataaaattcagagagaagataggcctgtttgacattatggaataaatatttgactttgtgaagtaaaatagcttataacagaaaaaaaatggagaagccatgtagcacgggttgaaggactaaaaatgaaaagaatcccagtgataggaagttttacttaaatttgatgaagacaacaaaacaacaaaaaacatgtaacttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggccaaaaacatgtaactttaaaagtaagcaccaatttgtggtacattttgcctggaactgaaatgtctcatctggaatggaaggtagaggaaaacttgaaattgatcagattacttctattgtcctgctctgatgttatacactcattacaatagccaagctagtaacgccgataaattatctctcttgaccacatgcaaaggtacaagtatctcccagtcatctcattggcaaatggaattttccccatcattttccatctccttaatagtaaccatgaatttacagcgaccgaagacaatcgaactctatactgggcagtaaagtttagagacaggtaacttgaaattgacatacccaggaagcaaatgtggaagaacttatggaaatttctagtgagtacaggaatatcgagataactgagatgtgattcttgcaatcaaggagttcagagtctagtaggagagacaggtgttctgccagctctgacacaatgtgggaaatgctgtgagaacattgtgatcacagtgtgcttaaggtgccaggtaggatttcacagaggaggtgacaatttgaacatgaggtgaaatggaaagccaggagtgcccaggtaacaagtatcttatgagcaagaaaacgtcaccataggttgtttttgtttgttagtttgagatagagtcttgctctgtcgcccaggctggagtgcagtggcatgatcttggctcattgcaacctccacctcctgggttcaaacgattctcctgcctcagcctcccaagtagctgggactacaggcacatgccaccacacccaactaatttttgtatttttagtagagacggggtttcaccatgttggccaggctggtcttgaactcctgacctcaggtgatccgcctgccttggcttcctgaagtgctgggattacaggcatgagccaccgcgcccagcccaccataggttttttacacaaggcagtggcatgtttcaacttatgtgttaaaactggagtctaaggtggcaaagagagcagttaggaggtcagtataagcagcttgttaaagttactcaagaaaaataaaattcatgatagcaatataaaagagcaacaaatttccaggtctccaaaaaaaaaaaaaaaaaaaaaagttcatagcccactctactcccaccctcccttcctggaatacttgaccttaaagaggaaacacaaccctctgggtaagttctggtccagaggttggttctgcatctccaggtctagtacacattgttaaatccatgttcacacccaagcccagcagccagagggcgtagaaatcctcaggggccacctggcttggccatataccatttcttcctcctgccactttgtactctctggcctgtgtttttagagtactctctagcttctagatacaagaaacttttcaataaaaataagcaatttatctgtgtttttagtctcacagcactttggaaagtaacaacttaacccaagcaataaaatagtgatgcatgtattgtagtaaagcctgaagtttcagctttctcaatggaaactgcttcttaattatctcttatctttaacatgagattttcactattgtattctaagattcaggttatatcagcttccacatgtttttctaacttaaagtaccctctacatttaacatttttataaagcaaggtaaagatttcagcatatatgtttaaagagaaatgcaaccccaagtgagagatatcattttgatgatgatgatgatgatgatgaaaatgatgatagttataatagaaactgttatattgtgactattatatgccaggcactattctaagcatgtatatttataagctcctttgatactataacccagtgagataactgtatttccccttttataggcaagacaattcaaagcacagagaacataacagattttctcaagaacacacagctagtaaatgatgcaatcaggcttaaaccctgtccatcttgctcagagttcatggtcttaatcattaagctgtgctccctctgatactttaaatatcctatgcttttatatttaaacataataaaatgttcaaaagtttcaacttcaaaaatatgagtctgccagccttaggcatcttgtttaattgtcgcctccttgccatctagttctaggtgcaggcagtcactatgcttagctatgaaagctaccttcgaggaacagcagggagtccagagctgttgggaatgatacaaaacaaatgtaatgtttttcacctatatttgtgttctgagaaaatggaagcagtagaatatttataaatatttgttagcactcaggattctataagtttgtctttggttctcagtggcaggcaaaataactgctcctatattgaagatgcaggttcaaaggtgtgagtgtggtttgcagactggcctccgtgttccagcattcctgagacccggctttgttatctagaatgggttaccaattattaggtgtgtgctctggaagcccatagaataggcaacagtatagttcctggagctctgtcttctagataaatattatgttcatttctgaattttatgttatatggatgactaaaacacaggtgaaaatggggacataatatgattcctgttctcctgagacataaacgttaatcaaaagccacagggaaaaagatgttaatgcgccagttccagacagctgacaatagtgctgttcatgctaaagccactaaagtcagtacagcaatagccatctgttattgtctcaccttcacagatccgcttggccttcacatttttatgtacaaattcttatttctattgttttctcatttgaacagagcatcatggtccaccatcaggaacaaactcagccaggcaaagcccagccctgcagcacaggcccatgggacagtcacaggccaaccacatacctggggacaggtggggctattttcaggtttttgtttttgtttttttcttattctctccttattgctctgctgttcataaccccactccccatcatccacccccatgcagtaatgcagatgccagctgttgaggtcaaaatgacaactcttgcctgttcctcaaataccgtccccatcacctccacccattcagtaccttcgtccctcttccagcctccatcccaggcacagcataattatccaatcttgcctgacatgcgaggattagaaagaaatgacatagcatctggctctgctactcttggtcctcatagttttcatagggaagctgcagacccatatggattgctgtcttatcagaccacctgagcagagcaggttttgtgtgtatttctgtcttctttcattgaaaatattagcctagatttccagaaatccagcatcttcacgggcattggtgctgcaggagagccatttttcactgtgacagggtcagcttaactgccctctggtgtagttatttgattgcagttttctttgatataaactgctctgagatgtccttaaaaaaattgtggatgttgacagacttcaaagtatgttggaattaatgaccaggtttctcctagcacccctctgatctgattttagatatagtctgtcttcatagtggtttgtcagagggaaaatggcaaggtcgagcttttaaaagaaaagaaattaatctgcctttagactgtttttcattttctcagttcagagagtgacttgatttctctctcttgtagaagtgccctagaaggtgaaattggaaaagatgtctccacttcttacagacattcttggtcagaccacaagcaccttgcacagcctgacaccgcagtaatttcagttgtaggcagtcggcacaatcaggtaaacaaacatttccccagatggggagtgatattttgagttgccataccactggcattggtgaatttttattgcaaatcagttcagataaatttgtttccaaaactaataattctcgaagacctgccatgtgtttggcattctgctggcattcataggagaatgttaggagtgaaagaaaagtttcccctacagcaggagagctttgaacccttggttaagtacttagaagtaaatagtattttagataatcaaattcaggtttttttgtttgttacttgtttgtttccaggaaaattagtcaaacgctacttaaaggaagcactttccaaaattctgttctctgattgttgcattgcacattgaccaactagaaaagacatgtaaccttcagattaatttaggctgcatttataaaaattaagtagccctttaaccaaaacctacattccttctttacaatatagaaatgcacattgagagtataaatcatttcttccagctatagaagtaatctttcttcaaaatgtaagtaaacagtccatgagaacttgcttttcttatacttctttctctctagaaccttggttgttatccagtagagctggagagaggcccccggggctttggattcagcctccgaggggggaaggagtacaacatggggctgttcatccttcgtcttgctgaagatggtcctgccatcaaagatggcagaattcatgtgagttggtttctgtctgtaaccttaggttcaggctctagactagaaacttcgaaagatattaataattgatttaaagggaatgcaggaacctcctaaatctaaaaagcaggatttgtcatcactggtagctaaaaaaggcaaatgcttgtcattttgcttttctaacgccctgatgatttcatttcttctcttcagtgtgctaaaccatattgcagttatgccacttttgccttcttgaccttggtcaataagaaaattcatttcttattcacatagtcaacatctgagggtaaacgaattaataaatacacttttcatcttaataagagtcttgagaaagcgaggatcaaatagaatctttaactttttccaggaggcaataggcccaggattttttttccccactcttagctaccgggagaggtaactagaggctgaaaagcgtggctctcaacatttcttattgtttgaaggcctagaattcacatcagtagtattccatcatagatgttctcaactctgaaacactgtgacttcgtatagggaactgcagaccaaattgtttatagatctgcataagatagtttttccttcttctctggatgttaattaaagaggaatcttatatagaagacatttgctgctgggcgcggtggctcacgcctgtaatcccagcactttgggaggccgaggtgggcagatcgcctgaggtcgggagttcgagaccagcctgaccaacatggagaaaccccgtctgtactaaaaatacaaaaattagccgggcctggtggtgcatgcctgtaatcccagctacttgggaggctgaggcaggagaatcacttgaacctgggaggcagaggtcggagtgtgccgagatcacaccattgcactctagtctgggcaacaagagcaaaactccatttaaaaaaaaaaaaaaaaagacatttgctgtcttcaatttaaaaaaaaaaaaaacttaactcactggcattcagttaggtgatacattaaaaacttttaatttctagacaccgttccccctactactcaaaagaattttggatttcctttccctgccaccagtaggcatcagagaaaaggaactttttttttttaattttaaactaagtaattcaattagaaaggcaaatgatcctggtaattattagatggtatattctagtaattattagaaaaggtgcttctgggtgattgcagttttgaatttttcatttcactcccattagtcatttcataaacacatattgagtgtttgcattacccaaagctttatgcatgctactgaatgagttgggagagtgactcaaaacaaataagatattatcctccctcaaaatgaccagacacatgcacaagttcaaagggatgaatagagaagatttcacagaataggtggcattgacaggtgcataggatttcaatagggagaaattaaggagagaaaacattccaggctgaataaatgagcaatggcgtaaaactaaggaagtataagtcatgtacagggaacttcaaatggttgagtttacttagattttatttagaaaatgcgtagatgaatagaggaaatgagaatataaaagccgatgggtcgcaggcataaaggtcctaggcagtgggaagccatgggaggctttttagccaggagtttcccctcagagcaatctgctgataaaaatctgttagtggtgtgcaggaaggatgaagggactccaggtagctgtaatttatgcatacagtggtagtggtgggagtataacttgaatggtaacgctttggatggaagataagagatgcatataagttcaaatttcagtgaataaaggaccagactagatgaacaacaagtatcctttaaatgagggatgaaggaaaaggaagagtaaaggatgactcagaagccttgccccatctgtactacgaaaaccatcagggaagccaaggggagaaaggatatggcaaagactgatggtgtagtaagttggagtcatgttgaggtgaagggaacagctagtagagcaggtgtaaatgtttagcaggcaattactactagtagtggtagaagcccagattgcgacattactgagaagtgatgattgaaacctttgtggtagataagatcactaaggaagaatatttagagagtacttagccaagggcagagctctgagcaaggcatgtaattagtggactagataaaataaagaaaatgggaaggcgcagcatgcagagccacagagccaaagctgcagagtgtttatgacaaagagggaccgatggccttaatacagctcgtcaagaactgctgaatctactttcttatagagacaatttcatatcgtgacaagaacatgggtttggaaatcagacaggacattctcctgagtttcctcatctgcaaaatgcagaaccatatgtaatatacatggtccaagtaaacttcttaaagtcttaataagagcatcttgagacactgtttacagaggatggcatatttattcctggttttcttggtcctttcccctcccctcccctcctatcttctcttctctctctctctctcatctctctctctctctgtctctctctcacacacacaacctattcagttactttacatctgtgtttcaatgcttctattgtaaatagtgtcacaaaaatccaattaaatgataaattaggatataattgttttaaatgttggttccaaatataaccctcagatccactaatctcagtaaaccaaaggcaaacaggccttaaagcaaagtctagttctaaacatgtcattctcagccaggagtggtggcacatgcttgtaatcccagctacttgggaggctgaggtgggagggttacttgagcccaggagttcaagaccagtctgggcaacacagcaaaacatcctcagttaaaaaacgacaacatgacatgctttatgaatgagcagaaactttagaatctaatgatgaaatcagcttttatttcaagaataaactctgaaaacaaaagcaaatgagcaattaactgttagaccccagtgtgctctaacctgtaagaaaatgtcagcttttcagagaagtcactttttgggctattaaattatcaaaatcttgacttgatacagctcatgagggctttgcatataactagtgctcaataaaatgttattgatgacaactttctctggtggccgctgtccaaatgataagagtttatctctagctgacactcgcaccacggagccacctgagtgcccctctctgcctcccccgcttgcctctcctcttctccctttattaggttgacagctgtactttgtgtcctatacctattattccgtatctccagcacctgatatggtgccttgaatattcatatcaggtgctccatagatatttgttgaaagagtaaaatgtatggataataattctagatactgagagaattattgtgtgtgtgtgtttttatttttaagatcagttcccaggacttattactgggtgaacaggactggggatatatgaagtaattagcaacaatcttagtgtcattaagaaaacaagaaatgttaatttgtaacatagatggaaggatattgagaatcattgagaggttcttcctttcggtctggttaagatttagagaggagagagaaaaaaagtgttctgggataaggaactgagaaatagctgaatggaaaaggttcatattagggaatagtgtcaaacttaaatatttaacgtagaacataatcagatttagaaaatattaagtgtttgctgtctttgaggcaacatgtattttcctacacaacatgcgtttttacttatattagtctcaaaaactctgagataggtgacattatccccacttacagatttaaaactgaggctcaaggagacttagtcacttgcagagatcactcatcctgtgcaggccacagtgtgacccaggtatgaccctagtccgtcgtcctcgaagatcggttcatgtgctttccgctatgtcaggtcttggcttgagtccagtttggattggatttcattgataggcagacagtttcttaacaggttgtgagataatataagccatgtggtagaaatattttgtcattttaatacatttgtagtggatgttgtttttaaaacgacaagactgcctataaaaaaatagtgatttgtttaaaaaagggaacattctttttccctattcttcctacttcttttcttttggttctcctattttttttcctttctcttttctttcctctctcttctctgtccccataattatttttcaataatacaaaactgaacttgaatctttgttctatttatcaaaagatgttttctccaaattattttttatcacatttttaaagtgacttaaaatgttaaaaggatgtttactgggtgaatttactcctctgaatttccctctcagaagagtctttttcatctgtagttttgtgtatgtaggtctctgcagaatttctcccactctgagggcctgtctaccataaatcttaaagcaatggctccccctccttcccctcattcagttttaaagttaaacagaaatgacacctggtggcaagtctgttcaattacaagtttttgttgttttttttttttgcagtttattgcaggaaaagaataaaaagtgttctgggttggagagcttaagctaaagaatgtgattgaaataaattataacctcaaacctgttttacaagatatgcccaaagcagtgtccaaatactatctactttaattttctttatcagcaagattatatatctagtgctaatttcttacctacattgcctcatgaaaatgattcttcttccatcatttatcaagggaaatctaagtattggcttttgtttcacttatatattctggatagtaaggggtttctaaattattctccatcctgctgtcttactttggttttattaaggtgttttcatcttacatattaaatccatcaatcttgtttctgatattgtccatttgttcaagagtaagcctcccttgtttaaaataagtatgcaataagacctttagtctatttcatagttgacttgaatttttttgcattgtatagaatggagtgcagtctacagttaaatcttcgtaatgatacactttaaaatagcttgaaaactaatatttgcacttggtatataatcatgttttatcttaagtcctcccagaatcccacgaaataggtactaatattatcctcatttaacagatgaaaaaaatgagaccacaacactagaaagaggtggagcacaagatgtgaaccacagcctcctgaccgcctgtgccatgctgtatctgtagaaagagttggcccactgacctttgttaaatattgagtccttctgttttgttacttctggattggcttattattatttctattctttagtcaccttgcagctagcttcaactcaaaggaacttctggattgttttagtaagctcttacaaatatttgagtatttgctttttggaatttcagtaatatgccattgtctaatttttctgttttgaagccagtatccttcattttacatgtcaccttgaaatatattttttcaacttttttttaataagttcagtgcggcacatgtacaggtttgttacacaggtatattgcatgattctgaggcttagaatatgaatgagttcccatctcccaggtagtgggcatagtacccaataggcagttttttagcccttgaccctctccttccctccccccatcttgtattcccgtgtctgttgttctcatctttgtgtccatgtgtactcagtgtttagctcccaattacaattgagaacatgaggtatttggttttctgtttctgcgttagtttgcttaggataatgatggcctccagctccatccatgttgctgtaaggggacatgatttcgctctttttatggctgcatagtattctatggtgtgtatataccacattttctttatccaatgcagcattcatcaacatgtgtttgcttgaaatagatttaaaatcagtaccatcattatgtttaattaggtctgttccaaagttatacttgacttttacatattttccctttttcttttaaaataactcagacatttctagtaaatcacaatggtactaaggtatatcttattctgatccctagttttatgtttattttcctgaaaaatgatttttttttttttttgagacggagtttcgctcgctgcccagactggagtgcagtggtgcaatctcggctcattgcaacctccacctcccaggttcaagtaattctcttgcctcagcctcccaagtagctgggattacaggcatgcgccaccacacctggccaattttgtatttttagtagagaccgggtttctccatgttggtcaggctggtctcgaactcccgacctcaggtgatccaccagcctcagcctcccagagagctgggattacaggtgtgagccaccatccctggccctgagaaatgattttacactaacatcactaagtttatgccagttactggttttaaataagtgttcatattaatctattctccaagtttaagtttttaagaattttaatctataaagatgtcatttattcaaatacctcatgtatgtacaggacatagcagcagttcaaaggaatgagcagttctccctggaggccaggaaaggcttcaaagataagagccctctgcccaggttttaggagatatatttaaaattcagctcaagtttgaaagtacccttcacattcggacatagctctgtagtatcatttggattgttgtttgtaaaatgtctaacatgtacccagtgctctcctgcgagagttgataagaggacagatggcagcaacaggaagagacaatgtccaggtttactcacgcataaaaaccctacacagcaagtgcccaggtttacttatgaaaatcctacacagggccgggcgcggtggctcacgcctgtaatcccagcactttaggaggctgaggcgggcggatcacgaggtcaggagatcgagaccatcctggctaacacggtgaaaccccatctctactaaaaatacaaaaaattagccgggcgtggtggcgggcgcctgtagtcccaactactcgggaggctgaggtagtagaatggcgtgaacccaggaggcggagcttgcagtgagccgaggtctcgccactgcactccagcctgggcgacagagcaagactccgtctcaaaaagcaaaacaaaacaaacaaacaaaaaatcctacacaggaaagttttatatggctattaaagatctgggcatcttcaaatcaagaaccaaattctagaatttgattaacattctaaatttgatttctataaatttagaaaattccaaatctgattctagaatttgattcttgatttcaagatgtccagatcttagttagtagccatataaaactttcctgtgtaggatttttgtgagtaaacctgaacattgccacttcctgttgtttgttgtcatctgtcctctcatcaactctcacatggcagtactgggtacacgttaggtattttacaaacgaaagaatcacttagcaaggttgaatggctcaagagctgacaaaagcagaatttacaaaggatgcatagtttcatgttgttcctgtgaatgttctctgtctaggttggtgaccagattgttgaaatcaatggggaacctacacaaggaatcacacatactcgagcaattgagctcattcaggctggtggaaataaagttcttcttcttttgaggccaggaactggcttgatacctgaccatggtaagtaaagtagcccactagtagctgaaaagttgtatattagggaggggacagaagaaaaaggaatatatatttggagaggatagatattttactagttaattcagaggtgaatgctagaaccatgaaaagctagttacatagcagagttatcataaatagtattagaaaacaagtgacttaggcaggactttcgttggaatggaatgtattttaaatttaatcagaaaaaacatatagttgtttttgtagagaaatgtacctattaaaaaagtgtattagaggcaaacaatttaaataccataaaaaatgttttaaatctcttcaaaatatcccagctttttctcttacttagctaattacacattaccaaccaatatttttatttctgtaaagcaagataagtttatattataatgaatgcgcagcatgaaaacttaggcttttctggtgactcggcaaaaacaagttgctatcaccctacctggagacagggagttggacctgagaccatttctgtcctgtattaatgttaaacttcctgggtttccatggcatgttttgaaatatcatggtatttgaaagtcactgttttttgagtgcactattctagaaataaaggcagtaccacacccacgcagtacttgcctcatctagctccccacctcctgccctaccccaccccaccccaccgcttttgagggataagtgtagacataacctcctacagtacccttccagcttatgattctctgactgtattatcttccaccatctgcttgtaaatcatatgttcccagtgacatctttgctaactgcactgattttttttttttttttcacatagtcctaggctttttctcttccctcttcaggtttggctccttccggtctgtgctcctacgtgaaacccgagcaacattaaggctttcagggcttttcttggtctttccttaaaaagacttggtaaatttgcatgtcttgtaaatcactttcttcttttgttttcttttaaattaaaaatgatgctattaaatacatctatttctatcttctgcacttttcagtcttcttttgacattaaatttgacagcttaatgcaagagaattattacaaatgcccatgagcctcattctggttaccacagtttggtttcctttattaattagtgattttgccatatcctaaactgtatcaattcataataattagtgagcttcttgggccacgtaatttggttcagctttataacttgtaagttctaattgggctttactaatagagaatttacagatcatatattatctcactaattatatgtaattggaaaaaatgaatattattttgtgtatataaacaacccatccttcatgtatgaacagatgtctgtacacatccgcctttatagagagatatgttgtaaacatatacaaactgtataaaatactcaggctttttaagcagttacgacaattcaaatggctgtcaaagttcaaaacgtattgttcctatttgtaattctaaaatttaataatgttccattcaaatcacttttttaggtgattgggatattaataatccttcgtcttcaaatgtgatttatgatgaacagtcaccattacccccatcttcacattttgcttccatatttgaagagtctcacgtgccagtaattgaagaatctttgagagttcagatatgtgaaaaggcagaagaattaaaggacattgtgcctgaaaagaaaagcactttaaatgaaaatcagcctgagataaagcatcagtctcttctccagaaaaatgtgagtaagagggatccacccagcagtcatgggcacagtaacaagaaaaatctattaaaagtagaaaatggtgttacacgaagaggtagatcggttagtcccaaaaagccagccagtcaacattcagaggaacatttggataagattcctagtcctctaaaaaataaccccaaaagaagacccagagatcaatccctcagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctactgtatcatgtctgtttttatcctttttgttcagctgtttccacagtaatgaaaaagttaggtttggcttggaagttgatgatctcaatagcatgttgcatgtttacagagagaaatatgtgagtccttgcagaagaagagactgttaactcatcgttaaagatggccgttgtctcttctaacagctactgatgatgtcccactttaaaaataaaacccccaaacatcactactttaaggaaaaaaaaaatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaaca

SEQ ID NO: 1164 - DNA, 295071 bp, Homo sapiens; identical to SEQ ID NO: 1163

SEQ ID NO: 1165 - DNA, 115102 bp, Homo sapiens
ttggaaacaaaccaaaaactttatttacaaaagtaaattttaacttgcttttatatgtcatataccgttaatgatgacagcaacagatttaaaatacattgaggtttgtgcagctcatttccccctagttataccataaaactttataaacattgctttagctttgatgtttggtcacgtttgttgtgcagaagtcacgtttcagggtaggttcaccgccagacacggtcacatcaccattggctgtggatttccaagaagcaaaggagccaatctcagcaaagctcgcactggcatttttagctgcttaaatttgaagagcagttcagcaaagcttgtgctccctaaaatggaaatggggtgggaaggtcacatctctaaataaattcagccatacctctcctttcaaggaagcttcagaaacacaatcatgtttaaaacaggcatttttccctttgaaaatgactatgcaaagacaatatttaaaattatgaaattccttaatacactgtaatgtaaattgagtatcccttttccaaaatgcttctgaagagaggtgttttggattctggatttttttagattttggaatatctgcattacacctactggctttctttttttttttttttttttggagacgaagtctcactttgccaccggggctggagtgcagtggcgctctctcggctcactgcaaactccacctcctgggttcacccattctcctgcctcagccccccgagtagctgggactacaggtgcccaccaccacgcccagctaattttttttgtatttttagtagagatggggtttcaacgtgttagccaggatggtctcgatctcctgacctcgtgatccgcccgcctcggcctcccaaagtgctgggattacaggcgtgagccactgcgcccagcctcggctgagcattcttaatccaaaaatcccaaatccaaaatgctgtaatgaacatttcctctgagcatcatgttggtgctcaaaacgttttcgatttcaaacacttcagatttcagattaaggatactcaaacctgtatatgatttgatagaatttacccattctagacttcagaaagtgacctataactacatgtgaaactactaatattgtttaattttatatatatatatatatatatatatataaattctttaaatataatgtgcaaaagtgcctgtctaccttcaaatactatctaagtggtattttactggttctaatacagttgaccattgaacaaccctgtttgtccagcctggcctgaaaagaagtctatacttttaaaatgtcttccttttccttttagtagtttgactattaatgtgactaggtatggttttctttgtatttatcctgcttagggttcactgtgggttaatatttaacacaatttttcaaaattcttagcttctgtctcttcaaatattgcttctaactcattttttctctcctcttattctcttattccaaccccatgcatgtttatttttttttcacggtttccacatgtctcttgtactcttctctgtatttcctaaccattcttccctctgtgcttcagtttgtttactttctacttgtcttccagcagataagtgtcttccagttcacttcaaataatccagtactgagatcttcatttcagttactatatttttcagttctagaatttccatttaactcttttttattgaccccaggtttctggtgaaattccctatcattccttctattttcctggaaacattagacatagttattttaagttccagtatgataactccaatatctgaatcacacataagtctgtttctattatctgtttttttattattattatgtttcgtaatttttgattcaacactgaatcctgtagactaaaaattgcgggggctctgggtatgttttctttctcctatgaaggttacattttcttctgtcaggtggggagaaagcacacagatcaccttagttctgctctaggctaattgtaggtcaagtctgcttggagtgaaactgaagcagaccagatctaaaattaggctagagcaggcttagggcttggccatgtattaattcacctgaggagctgggatgctgatcagagccacttcactttaacaagcgttgaattccaccctttgtctcctcagtcctatgctgctgctgacatttttgcttacatttttggccttgtggcttctgctagatctcttgaagtcttatcccatgtatatgaaggctaaaatatcattaagtaactcaagggaaaggtatatccagagtctgagttatgatttctattgttctctcctgcctgagactgtgttcctcaagttctaggctcttgggcaatcacaaacccaacctctggctcctcagccctgcagcattgctgctttttgctggcactctacttcttgtactatgaactggcaaatgcctttgggggagaagctagggtgaatataaagctctccctgttgtacttcccttttcttattttttttttttagcttttatatttgtttttgagggcaagtgagtccaatacaagcaattccatcatggccataaccagaagtctctagatagtaaacttttatcagaggcttgcaaaacagcaaaaaactagtaatgtaattaaacttcaagtttaaatgattaaatggaacaatctttgcccttatcaaaaaatattttttttgagaatctcaaaaaaattgggtgcttagaattcatcatatcttagtattcagcttaatggataaattttttttatctgtttctatattctgaaaaatacaatcaggtgataatactattaatttttaaaactattataaaaaaattcaaacacaaaattaggtatttattagttgtaaagctttgtaatattagaaattaagattatatgtgattctaaaaaacccaactgaaaacctagaaaataaagaaaaatagctttaataaaaaaatcaattagtaaagaataatatggaatatttagtttattagtatagatcagtgtttggggctctgtgaagaagaatccatccttttctgaataaaaatgaaagttattcatatataaagttgataattttttcttttttgctccaaaacagtccctaacaatgacactgcaacattaatgaagaggaaagtcaaactaggggcagtaactactgagaaactagaacataaaggggtaggtaacagagttactgaagataagacttagatatgcaattaccttctagtcctataggtggcaggtgctgtggagctggcacagagtggtagacgaggaagcaggccagcatgctcagctgtgattcctccaagggctgcccgctgaggtaggcgtgcacacacatatcacccccgactgtgagagaaacaaatggaacggaaccaactgatgacagaactgagaggcacaagaaatatcttctattactttttcatcaagaacttattgaacgctcagcatatataaagcaggttctatagccggtattgaggctactctgacaagctagactgagtccctgtcattgtagagtttagagtgttgttgggggagacagatattacacaaataatgacacaaacaaatgcataattacaaattgtgaggagtgctataaaggtgcagtggtcactgtggttgtctccccgaaataccccttgtcacaccctaccctccaccatatattatatttgatgggactgacttcagctccagaactagatccttactagtcttggccaggggtcctcaaactttaacatgtgccagaatcacctggaaggcttgttaaaccacagatgagtgggccccactccatgcacagagcacagagattcttattcagtaggtctggggtggggccagaaaaactccatttctaacaagtgcccaggtcatgctgctccataaaccacactttgagaatcactgatcttgggtgatcaaggcaatcccattctcctgatgcagtgttagttcagagacaggcagacccaggccattttttcaataagagacattctctgccacagggatagattgagaggtgtgcatgagatgcaactcgagccagaaacctgaggaggtacttaatgacaagcttgctggaggctccagggaaagaaattccctcattctcatcacaaaactcctagaagcaactctattcttcctctgagtatcatgctgagctagaggtgaacatgttacagccatttgattaccatccgaaaaatgcactgaggataaagtcatggcacagaatgtagctgatggaacctcagagaaatggagttgaagacactggaaaaagatgaccctttacgtgccttacctgcagacctctaataacataggcatacttgtgtccttactgtttaaaggcaggttaagtcaggccttcttttacttgcaaacaaaggcattttgatacagaaaaaaggtagagagcatgagcgggcaggctaaagatgtcaggaaagctgcctgagggagagtggtcttggaaggcctgggaggaaatgccattaaaactgaggctgcatggataaatatgagttgggcaggtgaagaatgagaggaaaaggttctagggagggaaaacagcatattcaatggccccacagtgaaaaggagctcagtgtttttgagtaagtggaaggggccagggtggtgtggggagcaagtggtgtaaaagaggctttgttgaggaaaacaggcgccttgcaggtcacacaggtcctggtgccacacagtagggatttctttcacagctgaatcaggagccattgaaaagctttaagcaggagtgttacatcagtttattctttaaaagactgttctgtcagttaaattgagatggttggaatggagatgagaaaaagcaaggaggctatttaggaggctataacagtggtccaggcacaaaatcatcattctgttctaggtagaaatagtaaaatgtggacaaattcaagaaatatctatgatgaggattgaaaggcatcagcaatgggtcagctattgcagagaagggaaggagggaaaggagcaaggatgacttccaaaagggtcaacaaaggagtgacagtgaaatggtgacaaatactgagaatttttaaagaggattttttttaaaaattgggaaagtgtgctatgacaaagtcaagggaggctcatttcaagaaggaaaatgtagctaaaagcctcaccattgtagagatggagtgagatgaaaactgtagactccactgaacacagttgtgaggatgtcagtctactgggaggtggaaacatttaggtttgggggaggcagcagagggagaaaggttaagggagaacagatgagattcttctttgaacagctcatcatgaaggagagcatggtggttcagcctctcttcaatgactttctcatgtctaccagcattttgtttcactgattttctctattgcttatctgtttttggtttcattggtttctgcttttatttgcttgctttgggtttactttgctttcctactgcacttgacaagtcttaaaaaaaaaaaaaaaaaaaaaggacaatgccaaaaattgcattgcaatccactgctggtgggaaagtaaaatggcacaatttggaaaattgagtgtggcaatgggtgaaggtacaaatgacgcaaaaataggagaatgctggcaactattaaaattggtgttgtggtttattacactagtctacttactttgtatattctttaaatttccataacaaaatatgaaaaagttaataaaactttttaaagttcttaaacttgaaacccgctttctttgcccaaaattataatttgaggagataaatactgtacaaaacatttatataggccaggcgccatggctcatgcctgtaatcccagcactttgggaggccaaggcacgtagatcatgaggtcaggagttcgagatcagactgaacaacatggtgaaaccccgtctctactaaaagtacaaaaattagctgggtgtggtggcgtgcacctgtaatcccagctactcaggaggctgaggcaggacactcgcttgaacccaggaggtggaggttgcagtgagctgagatcgcgccactgcactccaccctggcgacagagcgagactctgtctcaaagaaagaaaaaacaaaaccgacatttatataatataaattggctgcattttcagattagtgtagtgatttaatgggttatctcagatctaatgagttgtcagtgagtgatcctgaaagtccacatatgcatctgtgatttttacacacaaatatgaatgcaatttccaattttcagttaatttattgttctctaccccaaagccaactgctagtgcttgtaagagaggagactatatatttaagaggttttgttttaaaaaaaattctagtttttcactaaaaaataaacacatttttgataaatctgtgtggcaagtcaaattcaatggaggctgacagcaatgctggaaaccaccaaatgcgctaaagagcaacaaggcaatcagggccctgttttagagaatgttctaatcactgccaaagttccatacattatatgaaatgtgcaaatcagggaatctgcaaagatttaaggaagtatttattatcaatagcaaaggtctgccataggtgatcaaatgttaaattgaataaaaacgaaacacgaaaacctttgaaataacatgtttttccccaaaaatgaggataaaaatgactatccaaaaaattatgaagctatatgatctttgaatctgaacaggaaatgacaaatacaatgcagcttttaaatataaacatggagagtctgaaatcaggctttccaagtatatccctcacaacttggtttacaatttaatttttttcagaaatttatttcctagtgttacaggtggatagttttaaactcaattatattcaaacgcttagggtctattgattactaatagttttcactaatcaaagcaagaattgtttctactactattactaaggttagtattaacccaaagcaagcaactgtcagatatttactgggagcatttgaatgaactaaaaagaatgaaaagatcaaggagtctactcctgaaaatcagtttcaggtgtatttaacacacagatacatttccataaatctaaaggccccatcgcttgcctcatgtaagtcagaatcacttctacactgttaacgagtaactacaatttccttgcaatcacaaatcctgctgatagaaagccaccactgtgacatcacatagctgtgcggtcccaggttttcaaaactgagttggtacaacaagctcactcagcaagcacacgtcaacttctacatgtacatgtggtgccagtacaaaaacaggatggctgctggcctcaggaaggcaacaggccacacccctaggaaacaggagacagaggcactggaaaggaaatgtgacctgatgctagggaagagagaacaaggtcctgagcaccaagtggtatttaaaatgctataaatattatctgcctgggtcagatgtattttactaaagaagctaaagtagataatcaaagtctaattcatctagctggaaacgttaaatctatagccattcttgcttatactcagatttatcttgcttaccaatgaaaaaacaaagttacaacagaaaagcctgaaccgaatgtatctcaaaagcacaagagcgctatgctacaatgctactattaccttgtagccactggtccagggtattatcaatggtgcacttcacaacagggaggaattccgagttcataaagagcccccgcttagggtggttctgcagccgctcctgatggcttcgggagctgaaaaactctaacaccaactttatctgccaaagttcagaagtctcagacatttctcttctcccaagtcttcttatagccttgaagaggaaagaggacaacaatctatttaatcaaagagtgctctgtctcttcatcagagttgtagactgagtattttttaaatgtggctccgaattataaagggtcggggggtggtccattctgtgttttgatgcagtctgcccacagaggagccgtcactgggtacaggtgcatggctcacctccttcaatatggccctacatgagcagcttgcagggaaaagtaacaaaggtgaatgagctcattcttggctcaacagctccgaataaccaagacccaaaaggtcatagccagtcacctctgggaaactcgagctgggtacaatgacatggcagagatcccagggggtagagggcaagaagaacactactaataatactgcccttgagatccatctgcaagtcactacagctgcaaccagagaagatattcatgcataaagacctgccacccatgactgtaaaggtgtgagggttcagagagtaaaaagacacattctcagccagcaacattctcatccagcaaataacacaacttgttatttggctgctatacaaagaggcactgtgagaagcagtgccagcgtggataccatatatccatactttccaaccaaaaaagggtggattccagacaataatggcattctgggcctacttagttatattggaacttggtttttaatgatgttacttaacactgtgtgttttctggtttgggggaattatcctctgactaaatatatttttccattcagctttttagcaaattatttttatcattaaaggttatttctcttagacactgagtctcagatgctcagctgtgaacttactatattcacttaaagagctgtttaaaactagattctggatctcaccccagaaattctgattcaatagatgaggcatggaattaaaggatctgtatttttaagataccaaggcaaatttctgccaggttagaaaactactggcttggcttaactccaaatctgggtctgaaagatatgataatactgaaaaggtgtatgtattactaatttgcctaaagtgaataaattggtctgatcctttaagaacattattaagcattattttctgcattacccctttaggctcttttaaaatagcaataacaagagaaatttaaaaatgaactccaatgcctagataactgcatatggactctgtaacctcttgcaagctttatcacataggtctaatttcacagtactgccatcgctagggctctgttcactaacggctcacatgcagacttctacaaagaggcattgccaggagggaggcaaaaataagatgggagagaggaagggagtgctcccctcctctcctagtcaggggagacaaaagggaggaatgggaacccttaaaggaagacagccccccaaggggcactcctgtcaacataaagcccaagctttttggatttttgagagctttcaaattttatatggtttcctttcttaaatttccaaaagcaaatgggaaactaaaaggaaggacactaggaaccttaccacactattcagtgagttacttgaactacaggacaaatttcaccagaattggtataggtttttggatccatacctgatccattgcgatgtatgcaggcaacatctctggggtctcctgggtaacacattcatagagtactgaagaaaagagatccagaatttcctgtttctgcagaaaatcagaagttttgtagcacaaagtatattccaaaatcaattcaaaaacgaattgtatagcactactatggcccattcttaagttttataatgaatgacataaaagtaacactacaatcttttaaaaaagccacagcacatgtaacattaaacattaattaaaaaaaaaaaattaagtcccaagagacagttaaggatagtaagtgctacagaagagaggaatggaccaaactaggacaaaatgagtagataggacatcacagagctatgccttgggttgggctgggaagagtaggatccagaaaggaaacagagtaacaaagctgcaagaaaaaaaacactgtccagaacaagtttaggggaggcggcagagtcaagtccagctggggttaagggtgggcatgggctttattagagacccgtgacctggagtgcacagcccagctcttactagctgtgagatcttgggcatgtgacatctctcagtggcagtttcctcatctgtaagcccagaatgataaaatacctattctcagggtcataattaaatgacatttaagtattagcagagtgtcccatgtatagtaaagattcaataaaaaagagaggggaaggttatttcacttaatcctcaaaacaatactgtaaggtaggttctattataatcacttttagaaatgaggaaactacattttggagaggttgagaaattttctgaaggccatatatgcatccaatctttccttgtctctatggtggattaagtcaaagatctgggccaggcacagtggctcgtgcctataatcccagcactttgggagtccaaggtgggaggatcatttgagcccagaagttcaagaccagcctgggcaatatagtgagactccatcgctacaaaaaatttttttaaaaaagtagccaggcatggtggctacatgcctgtagtcccagctactcaggaggctgaggtggaaggatggcttcactccgggaggtcaaggatgcagtgagccatgatcacgtcactgcactccagcctgggcaacagaaaaaaccgaccctgtctcaaaaaacaaaaaacaaaaaaataaagaaaaatctgctaagcacccttggaatcttgaaggtaacaggtgtatgaacaataaaaagcagggttataatatacagaggaaacagttaatgaaattacataaaaataagagaaaggtggtaaacactgaaaacataaagcagaatatggatgggtatcattcttgtagatgacagaaactatcatctgtcaaaactgatgtcttataaattttaagttgtttcttctatcaaggtagaaagttgctgaatttaatagttttaggctatgcaaatctatacgtgccaagcaaaagtcatccaatgtgactgacgcatgtcatcaatctcaaagatagatatagatagtagagatgttttgggtgacccatgcatagaaataataacaaattctagtcctggggctcggcaaaccatagaatatatacctgacccatgttcacagttggcttgcagaaatattcagcaaatgacagaagtgctggatcagaagtgaatgctgagattgtttctggctaaaaaaacaaacaaccacaacagtataagacaacaaaagattattttccttacgcttaaactgtaatacacacagttctaacaactctacctcccctttgtcacccaacattcccaaaaaatcccagatgatgcaaacttgcctcatcaacctgttctgctaagaagttacaagaagcttttgcacaagttaacatgagctactaatttatcaaaaggccaataacaaacaggtcttcctgtttacacaactcatccaaaaaaggcttttccctccttcactgactaattaaaaagcctaccagaaactagaattgttactgaaaaggtaaggaaaaaagaatatcactcaagccagccacaaaaagataaacagtgtatgaaaccacataaatgaggtacttagtataatcaaaatcacagagacataaaatagaacggtggttgccagggactaggggaagtagaatgaggggttattgttgcaggtatagatctcaggtctgcaagatgaaacagttctagagatggatggtggtgatggttgtgcgttattgttgcaggtatagatctcaggtctgcaagatgaaacagttctagagatggatggtggtgatggttgtgcaacaatgtgaatgcacttagtattactgagctgtaacttgcaatggttaagacaataaattgtgtgcattttaccacaactttttaaacttgggaaaaaaacagtatcactcaaggttcaagattgaaaatgaaatatgaaggtattactattttccactgaggtttatattttatttctgaactccagtaggcaggaaatagaaatagcttttaatttttatatactttcttcgttcaaactcaagtctaaacttatctattttcttcacaaattgggttagagtctttggaatatgctctaatttttagaagaagcaatactacaaatttaagttaaactgtgtccaaaaatctttcaaaagtatttcataaacaacttactgaatactgccaaacaaaattcaccaatgtcaaccctgggaactatttatacatttcaatcctgggaaccattataaaggcttggtcataagtaactgactaaaatgaaatatgagttgaattaaaataaactgctgtctccgtacttggaagaacaaaggatgctaactcagtcctctggctgccactcatccagtccgcctgccccacttttgccgtctaattattccttagggtcctaactactttagactactctactttgtatcaccagcagggacacagttgctcatggaattacaggaaactgaagttaaattcagaagtcttaatgcctgattatgggacaaatttcttgtgttggaaacttatctgagtcaagaatatagagcaaaatatgtgctgaccccgccgtgggaatgagattgcttcctaccctcatttatcgtaactatttccttatttcaaacactactgcactggcagtcgagtactgtgcaaataataaagcaaactaataaaagaagtctgaatctgtcatcagtttatcctcaccaagattaaggaaacaaatggtggtttttaaatggagttaataattgctagcttgcaaaactcgttttctatttttgctatgaaattaagtaaatcttcaccgatttgaagatcaataataaaatcactatttgttacagtgtcaagatatggtgtgactgtccttgctgctaaatgtaaacattaacttacagtattttactttattatatatatattacttattatatacagattttatattcattatattttattatttattttatcacataaaaagcaaacagagccacagtcagtctttacaatctgcaacaatgaaaaaggaagcagatccacctttgaagtttatagcaatgggcgaggaagccggcaatttagaattatttctttccgtttttaccaatcaataatactaccttgaaagcccgggcttcagagttcctgttagcaacagtctgagccaacaaactttgccatcccattggatcttctttgtaggagagctgacccgcccggagtttaacatataaaaccccatccttggaaaggatggacctgaaagaaaaggaatgaatttaatataaggtattactggcagttcttggctggaaatagtgttttcccaataccatgttcacaggagatgaagcttttaccattttccactaaggtaaatgattatttactgtgtctaagattaaatcagtccctatgagaaagcctagaataaagttctgtttttctttggtgtctagattcatggaacttgttaaatgaggaggcactttgactattggctcaattacgagcttcgaagatagcattttgtctaacatttctttgtattccctatatcccctagctctatgcctagggtacatgaggtactaaatatctattaattggtttgcagcaagaagaaaataatgctgcaaatctaaggacagaacaatacagaaaacagctaatatacagtctggaaaaaatcacattgggaccaaactataaaaacttttacatgcttgttaaacttccttgaaatttaaaggcttaactgacatgctactttaggtataaatgtatcaacactctaaaataactgcacgtgattatttccacccaaaataaactggctgagtagtatatattatctacaataatcttaaatttaggagaactttctagcaaaagaatggtaaagagatgcaacaaaagatgtggtctgataaacactgattaataaagttcttttgtgcatgtacaaatcagctttactttctgacatggttaggctctgtgtccccacccaaatctcatgtcaaactgtaatccccacatgtcaggagagggacctggttgggggtgactggatcatgggggcagatttccctcatgctgttctcatgatagtgagtgagttctcacgagatctgatggtttaaaagtgttgcacctctctgtctctctcttgctgccatacaagacatgccttgcttcccctttgccttctgccatgactgtaagtttcctgaggcctccccagccaggcagaactgtgagtcaattaaatcccttttctttagaaattacccagtctcaggtagttctttatagcagtgtgaaaatggactaatacactttcttaaactaaatcttatgttaatataccaagagataagtccattactctcacaaggaagtcagtgcaagtttctcaataaataaatatttagggttggagtttgaaattaaaactttcattttctaacacaagtcctgtttcaaagatacagactgttttacagaagacataccctacatatagtcttgaatgagattaaagggtgatgagtcacattccagataataatctataatttataccttcttatatacttctattcacttcctaaaaggtaaatttgagaaatttaatgtacttacttcaagtgttgtgttcctttgcttaaatctatgagcagttcccagtatcttgggccttttactttaatctgtcaagataaacgtaaacatagtcaacccaaagctgaaaaatatgctcatctgacaaactgaaacctatgtttctcagaggaaacaataacagccagaaacaggcatctggaagttaacaagctccatttccagacaaaaaatgaatgtaaatcatgttctgaggccacctaagctatcaataaagatctctaagaaaagacttgctctattctttctgacttttcctcctgctgcagctttcttatctgctacaatacatgaagaaagctgaggcttttatttagctatctttaacgctatgccattctgttgaattgaccccttggacccaactcccgaccacacccagcttacctgctttaaaagatggagttctggaagaagggtaggagccatcaattcttctttggtttgttcataccactgagtgccctttacaaatgtaaaagtccagccacaattcactaggtagtcagtggaaacaacaaagaagaaacatctccacgctatacctccccctatccccgcagttcatacagagacctttaaatggtataaaatcctctctggtactcaaatcttaaaggactgatgtctaaattcctcacagggtatgtgtccttcccatcacttcaagccttgctcctcacaggccagcagcaccaaaggccgtgctccaatgctgctgggtttctgcacattgccttctccgctgggaaggagctccactcagtgggccaggcctagtccaaacactgtccactgttgacagcctcaaccccataactaacagctaagcgagggtgcttctctgcttcccctgcattccacagacatctccaattatcaccctctattcccattgtatccatgcctggctccccaggggatagaagttccttaaggaaaatgacaatgtcatctcattttgtaccccagagcctagcacggttttgagtcacagaaggtacttaataatttgctgaatgaaaggaggatataaaacttgtaatctatgcatctaaatgaaagctgtcatcaaatacacaattttgggttttcaagtttcagctaacaaatctaagaatgggtctaactcaatcagttatacaaaacactactgtcagtcacataaagttaacagggacattttcaaattataagctctaaggacaaaagagtagctgatgatccctaaaaagtgatacccagatcatttaaatgagcatgaatggcctggcaggatatacaataactttggaagcttccatttttatgaaagttcaattcattacttatcaccttttactggacaacacatttgaaatattatgacctgcaaagacggatgagtggtaataaaattacaagtaaatgatagggagagataccttgtaggtaacttctaagagggcatagcagggcgtgtttgtgtccacatccacaggcactagaagcctgggctccgcggccagcacatagaggtgccggagagcctggagatgatacctgttcacaaaaaagacagagagtgggtaacaaacaactgtgacaatatgagctctgcaatctgccgttgcctataagctaagacaggacagaagctcaagtaatatcttcaaatgaacagaaatcttaaaggcagataagattctattaaaaagtaatggagaaattatcttttaaaaattttatataactgacctttgacccaataattctttactttagtcttcacagtgaagaggttttacagggaggtaaaaagtatcataacatgaaaatatttactatcaaactgaccacttataaaatcaatcactctcaaaaacccctttctactcaacataggcatctgtttttatcttctcagattttttttttctttttccttaaggattgatagggaagaagggggaagacaggatgtcaattcttctcagacagcaaagttcttctacacatacatacttgcacatacatatacacacgtccttgaaacacagtacatcaaacatccatgtgggtatggcaatatttttctttggggttctcaaacagttttttaaactttaagatttctattttagaatgtaaaaacaaaaaagttttcatattttaagatctcataaaagaaaaataggctgggcacagtggctcacacctgtaatcccagcactttgggaggccaaggcaggtggatcacctgaggtcaggagttcgagatgagcctggccaacatgatgaaaccccatctctactaaaaagacaaaagttagccaggcctggtggcacatgcctggaatcccagctactcgggaggctgagggaggagaatcacttgaacccaggagatggaggttgcagtgagctgagatcacaccactgcactgcagcctgggcaacagaggaagactccatctcagaagaaaaaacaaaaaaaaatcgcccaggcgcagtggctcacacctgtaatcccagcactttgggaggccaagatgggtggatcacgaggtcaggagatcgagaccatcctggctaacacggtgaaaccccgtctctactaaaaatacaaaaaaattagccaggcgcagtggctggcgcctgtagtcccagctactcaggaggctgagacaggagaatggcgtgaacctgggaggcggagcttgcagtgagctgagatcgcaccactacactccagcctgggcaacagagtgagactctgtctcaaaaaaaaaaaaagaaggataaaatgagacttcaattttaaaaagctttatagacagtaacttccctcttcttactcaaatacatttatttctataaatctattaaaaataaaatcaataaagatcagaaaaaatgacactaacaaattacataaagattcttgtcaccggccaggcgcagtggctcacgcctgtaatcccagcactttgggaggctgaggcaggcggatcacaaggtcaggagatggagaccatcctggctaatacggtgaaaccccgtctctactaaaatatacaaaaagttagctgggcgtggtggcaggtgcctgtagtcccagctacatgggaggctgaggcaggagaatggcatgaacccgggaggcggagcttgcagtgacccgagatcacgccactgcacttcagcctgggcgacagagcgagactctatctcgaaaaaaaaaaaaaaagattcttgtcaccaaatggaaaatggcttcgtttacaatagctaagccaaatagctatgaccagcagtacgtgagtgtggctctccactgtaccctagccaataattggctttaacaactcaaaaaatctttcctaaatgacaggcatgaggccacatgtcagaagtgtattaacttaacaatattcttgtgctgcacctaccatcagagtgtggtcttcagattaggctacttttgtaaaacagctatctttcttctgtcgttggttatacattgtagtgtagtttaaaatgatggcttaggttactgtgataagtgctcctgacccttctcccataaacaataaagggctcttgacctgtctctggggagacaacatgggatgccttaagttgagcacagggctcaggtgtcttataggggctattttattctctgcccccatatgcaagagatctgctatgtctcaaactatatctagggaaacttaagtgttggtggttcctcgtaccctaaaacacagagcttttaactgcttctacatggtttgaagttctaccactcactgccacttctaaattgtctctggttttttgctgtattttgcttttcttgtcccgtctatgtcatttatacacaatttatcggcatctatgtgaaaggaaaaaaagaaactcatacagacattgccactaaatcagacaaacttttctcttggaattaaataattagagcacaaaaaaagtatcctgaacttcccttggcaactatcctttacctgatgattttttccctaaagacaactttacttgatctccttttgggtttagagcagttctatagatctgagaatggtggaagactggtcagtcatcaggtgtccaaagttatcctctggtctaatactttgtgagataattttcttaaaagatttagccaggaatataactaagttggagaacaaaacaatgctaatttggaaataattccatgaaaccaaaatacaaccaaatgatccccttagagaacttaataagtatcacattgaagacagaatcactagactcaccggttgtcagtgctgtgagctgggaagtgcggataaagggcacagagaagagcggcaatggaagaatttgatgtgctcaaagagtacctgcaaagtaagttcggtggggacagatgttattgattatattgcacatactttcaaggcattcttgagaatcaggaaactggtgtataatagtaaggcatactgataagatgccctcataatacaagagtgtcagtggtgtgaacattccacttttcatttagtccttgggccatttcaagatcatcactatttaaagccaaagtaatatcccataaatgttaaatttcaacccttgaagcaaggttttaacataaaatagcagagtagtgaagaccatgaatgcagtcctagaaattataaatattgaagagtcatgtaccaagtatgccaccttcttatccaattttattaatgtatatgcctatgtatatgcctatgtatataaatatacaattataaatctgagttttaaaaatacagaatgttgtaattggtatttaaacagttttttctgtttctgtgaagcatgatgattcctttagaatgactgactaaatgaaaaggcaaaagttatcattaaaaagttacaacgaggccatgcgcggtggctcacgcctgtaatcccagcactttgggaggccgaggcgggcggatcacgaggtcaggagatcgagaccatcctggctaacacggtgaaaccccatctctactaaaaatacaaaaaattagccgggcgccgtggcgggcgcctatagtcccagctacttggaaggctgaggcaggagaatggcgtgaacccgggaggcggagcttgcagtgagccgagatcgcgccactgcactccagcctgggcgaaagagcgagactccttctcaaaaaaaaaaaaaagttacaatgactgtataaacaactattcctctaaatataaattctttcctcaccaatatgatacacttttaagataaagtttcatagacttttaaaaatattctcttggtaaagggtctattaaaattttccttaaattactttattgttgctcaaatttagtatagcaaacaggcaaattaatctaaagtcccagagtttttctaaaaaatattttgaaataaagatggtgtaggacatcacataaaaccacttctaaaactattgagtataaatacttttcttacacacaaacatgcacacacatatacccaaatctctttccctgtcttttaaaataattggagtattaaataaggacttataattcattatatatgcttatatatttaatggattagaaagaagagatttcaaaatttaagcaaagagatacatctattttggcatgtgcatggaataagccattttctttgtacccttttgataaaccaaaattcaaagataaatattaagatactaatgttagaaattttgggtagaaacataatggtgtagctatgctaagtttaaatgttgttacagagtatatatgaccatttaaaaaccaaaaatcactagaaaagcagtagcagaatggtagaaaaatcaattcgatacgaaagaagagcgaggagagtcatacagtttggaacaatgaaagatgggattaagagacacggagaggctcattttgaaaggaaaaaattttcaaaaatcatagaataaaataaataagaattttcatagtaatatttctttgaccattattaattctaaacaattaaagaaagacaattccacaaaacatgttgagaggaaatacacacctttctgatcaactttactttttgtacttctgaaaaggtgagttccaatggtaagctcagtcttaaagaagaggggaaaattagcctacacagacactgtagccattgatcaaggtcacacacactacagctaaatatatacaggggtataccatattcacagaatggaagacaatactgtaacagattctaatctccttaacacagacacatacaatcaaggcaattctgatcaatattttatcagattatttagtatggaacagattccaatatttatatgaaaatgcaaggagccaagagaaaaacacacttttgaagaagaaaaccgagtttgaaggatttactcaactggataacaagactcataagacaatggagtattggtgcaagtacagaaaaacagaccagcaaaacctaatagcccagaaataaacacaggtgtataggcacttaacttatataatagaggtggtactgcagagcagtggagaaggataaacttttcaatagcagcgggaaaaaaacatggagaaaaatccgtgccaggtagattttagattcaaatgtgaatggaaaagctaaaaacttctagaagataagataggagaatatctccttttctctgggtaagaaaatatttcataaacaacacaaagaagtaaaaactataaaagaagaacattaataattgtgtcatcaaaagacaccactgagagagagtgaaaaggcaaacaagccctagggtggcaaagatagctgcaacaaacaaagctgaccaagggcttaggacatagtttaaagaatccacagtaatcaatacaaagctaaaccaatgtggagcagtcaacctcatcaaaacagaaagtagaatggtggctgccagaggctggtgggaggggcaaacagggagttgttcaatggctatagaatgtcagttttgcaagatgaaaaatttctggagattggttgcacggcagtgtgaatataattaacactacttaattgcatacttaaaaattgataagttttatgttatgtgtattttaccacaaataaaaattttaaaatagataaatataaaaactgggtagcaagagatttggacatcacaaaagaggttttgcagttggctattaaaagtgtaaaatggtactcaagaacattattcagaaatacagaaattaaagccacaatgagatcctgttatatacctactagttggctaaaactaaaaagactactaaaaagactataccaataacaagggttgacaaggatatggaacaactggaacttcacatcctgcccatgagtatgtaaaatggtacaagtgcactgcagcactgatggtattattcactgaaagtgaatacacacgtacaacctatgacccaattccacacagttctatatacaacaaaatcgaagacatgtacaactttccctaacagcactgttcataacagccccaaactagaagcaagaagcatatccatcaatgggggagatcaataaaatgtggtagtcatacaatgaaagtgtaatacaacactgaaacttgaataatccattgctacatacaacatgaatcttacaaacataatgttgagcaaaagtaaagtgcaaaaggatacatcgtgtataattcaatttaaatgtcaaaaacaggcaaaatcaacgtaaggtgttagaagaccagatagggctatctttggggaaaggaagataatagtgattgagaggggtgcatggcagaagcagagacgggtgctgtgagttgaaagtgctatacagaatcttgatctacatgataacaaagagatttttctgtggtagatagctctttgacctgtgcacctatgatttatacacttttctgtacatggtttttggttcatctaaagccagggcagtcttataaaggatgtagtcaggaatggcacatgttggaaaaagatcaagaaagctgaaaactaagaaaatgtcacaggatctggtaaacgattttgtttgtgacctttctgagaaagtagcttagtggaatggtaaaatttttaaccaggtgggcacaagcagtgatgcactgaagaaccgagcacagactattctgagaaatacagtgatgctcagtgtgtcagagaggatggtaattctactgagtagaccataagttgacggttaaactacaaagaagcccatcaagtcgaataatgctgctagttaagctaagagctagtcagaatttaaatttttcatgttatcttcaagatcaacgtaagtcacccttatagatctcaccaatgagatcttttcattggaaaaatacatattcacttaccttcctcctcccaaaaatagaagtccaagggccatgtggtgggctaagtgaaaaccatagttcatttcaccacccgttttcatgtgtaagaagcgacaaagctgcaaaacctttaggtttcctgagccagccatgaccatggcgagagacagcagcaccacgctcagacaagtttctaggttatgaggacctgtctgtcaggtgaagagatgacatcactgtaactgttgtgttacatttctttattatcagaactagcttagccatcattagaagactacaaaagtttgtaacttaaaaaaaaatctgggctgggcactgtggctcacgcctgtaatcccagcactttgggaggccaaggcgggcggatcacgaggtcaggagatcgagaccatcccggctaacatggtgaaaccccgtctctactaaaaaatacaaaaagttagccgggcgtggtggcgggcgcctgtggtcccagctgctcgggaggctgaggcagaagaatggcgtgaacccggggtgcggagctcgcagtgagccgagatcgcgccactgcactccagcctgggagacagagcgagacgctgtctcagagaaaaaaaaaatctgtaaatacaaatattttccctgattatgaaatataagttcaacagagataatttcaaatattgaatatcaagacataacaatcacttggaatgtcacacccaaagataactggtgttaacgttttggctttttctctgaatttttcctttacctacacatattttttccaaatgaaatggagatgttactctacacaatatttttaaccttttaaatgacctattacaagcaagcttcactcacaaaaaaaagttgtttcttttttgttgttgttgttttttttggagacagggtctctcactctgtcacccaggctgaagtgcagtgatgcaacagcctcaacctcctggggtcaaaggatccacccacctcagcctcccaagttgctgggactacatgtgtgtgtcaccacacctggctaattttttattttttgtagagatggggtctccctatgttgcccaggctgatctcaacctcctgggctcaaatgatcctcctgcttcagtctcccaaagttgctaggattataggcatgagccactgcacccagccacaaaaaattcttgtataacgtgattttggtagctccactgtgtaagaatatataaataaaccataatcaaatttaattaactacttttagacttttttgatgtttctaacttttccatattataaatagtgttgcataaatccatgtagcttttaccaggaaataaaatctctcagtcttgtcatcagagaagcaatgcctcaaaagcaactgaatccttactaagtactaatattttttaaaaaggaaattcccaatatttaatactgagacagaattacatgaggtatgacaacccgtgaatattatggccttttttattctcttgtcacaagaactagatacctgtgcatccttccagggtaatcatattctcacctaagttaatatcgcaaaacaaaaataaaaagatgagctaatggttcttcagatctctcattctacatttaaaaaaacagcagagatatctgataacacataagtaactggatcatcagtaaatttttttcaagtttaattttattcccaaggagaatgataaaaagacttacaacagaagcattaggtgcggacaaataagtcataaaatctttggcaaatttatgctagaaaaacaaaagaaaaaattccaagttataagaagcatcttaaagctttgttaaaacaaacaaaaaaaaagaacacagtaaactaaaatacttcttaccaaacagttaaatgctgataagttttctgagccagcaaatcgaaaacccagagacaagcaggctcctgcaattatgtagacatgtgcttggctgaaaacaggtgacaagaaatttaataatcattattttactttaaaattaacttgaaataagtaacaataaatattccagttctctaagctagtttatatctttctgggaatgatgaagtgccctcagtcagcagatttctatgtatttttttttcagcagaagcatcgggtcaccttactcatgaagtttgccccttgcctacagtttcatatgcagcaaaaacaatttttaaaattgttgccaatttctttaatggaaaggataaaagacaaatacatacaagttaaatctccaatattgctttttgagggcaagagctctatacttcagagagctttaaccaacgtcatgaacatctgataaataatggttagaaatatgtgggattcataattacttaaatcaaggacaatattactcccacatggtatatttcaatttaattatctgatagacgctaggatagctaatttgcattatacatcacttacgacaaagtttccaaattcaaatcctctgagcacggcaattcgatttcactgagagagatactattttctcttataatctgtcaatatagaaagcaagaatacttagatatcaatgttctcattacaaatatttaataatctgaagaataacatactgcttatcatggctatatttatataaagtaagctttaccaaaccatttcactcaaaagcctatattttaatctcattgaatgtaatcaaatttcaaatctaagatgggctaagtaagaataataattaagggcaggcatggtggctcacgactgtaatcccagcactttggaaggccaaggcaggtggatcacgaggtcaggagttcgagaccagcctgaccaacatggtgaaaccccatctctattaaaaatacaaaaattagctgggcgtggtggcgcacgcctgtaatcccagctacttaggaggctgaggcagtagaatcacttgaatctgggaggtgcaggatgcagtgagccaagatcacgccactgcactccagcctgggtgatagagtgagactccatctcaaaaaaaaaaataataataataataattaaatagggctgaacaaatataaacaggaagacgtaagtatattctaaatcagtaacagggtcataatattgcataccagtcaactgaaatacaaagatgatggctttagaattggggcaggggtgaggggaagaagtgggaaaagagaaataggagacaactctaatcagacttcttctttacgggatgtttccagcattaatccaacatacctaccacaggtgaggttattcactaggctaagataagctaaactgtcaatatgtttatcagctatgttacaactattgtttagaaaagacatccttttccttttagtataggtaatgaacaatttaccgaaaaacatacacagaatatctagctgtaataaccaagaagacatttgatccttttctcctaaaagaaaaaagccaaaaaagataaagctaatgtttgctaaacatatgaatgtatttaagatttattcttttaatcttctgagaagatttcttagaagatttcttaacatttcaggatgttttcttcaataaaacaataaatattggccgaacacagtggcttacacgcctgtaatcccagcactttgggaggccaaggcaggcggatcacttgaagcctggagttcgagaccagcctggccaacatggtgaaacccgtatctactgaaaaacaaaaaattagctgggcctgtaatcccagctactcaggaggctgaggcacgagaatcacttgagcccgctaagtggaggttgcagtgagccaagatcgcaccactgcactccagcctgggcaacagggcaaaaccctgtctcagtctcaaaaataaaataaaataaaataaataaatattagaaggcacttataatacagtcttcttatgtactgaatatcaccaaatcaaagacttaaaatatctttcctctttttttttgccttgagacagggtctccctctgtcacccaggttggagtgcagtggtgcgatcacggctcattgcagccctacctcccggactcaagcaatcctcccatctcagcttcccaagtggctaggactacaggtgcacaccaccatgcttggctaatttttgtatttttctgtagagatgggatctcactatgatgcccaggctggtgttgaactcctgggcttaagcaatccaccctccttggcctcccaaagcgctaggattataggcgtgagtaaccgcaccctgtatgtaaagctttttatgaaagaaaaagtgctatgaagatgctagttgttattttacatatgccctaagttcaaacagacaagcagtttacaaagtgacctttaaaaaaaaaatcctccttttaacgctaggttgctcactacaaggaaccctgctccagaatcaatgtagctccagatgagaacccagagaaaagtggaagctgataggaaatatcaatcaggagaactgtgaaattgttatctctcctatttgcagtatccctgatgtaataaagaccaaatataacattataaagtctgaagtaaaaaagagagagatgttattctatactaaaagtccaaaaaccatattttcataaaaacaaaaaacgaccactgttttttgtgtttttttgtttgtttgtttgttttttgtagagacagggtttcaccacactggccaggctggtctcgaactctgacctcgagtgatgtgcccaccttggcttcccaaagtgctgggattacaggcacgagtcaccacaccaggccgcaaaaaagaccactctctgacatgaatttatactttccactttggaattacagttacttgtacacatgtttaatctcagtaagctgaacttagtgcatttaataaactaaagttttttgagaacactctatatgtctgatgtatctttaatgtattacagagtttagcacgtgccttgcatttacagaggattaatgagtatgtgctgaatgaaggagtgaaagaaaaagtatttcatcctacaatatacatttcaaagagcactttcaaaaaaactaaaatctctgacatctgaatatgctagagttaaaattatggtaacaaatgagcgagtcatttaaaacaattcttcctcacctctttcatatcagtgattaacaaaactggaagaactaaacaaataaaaacaaacctaggagttctacttcctcaaataatagatgaataaattcctatcagatcaactcatacaacaagtataaaccctagacaaaatataaaatccaaactatctatggcaggggtcggtaaactatttctaaaagggtcaaatagtaaataccagcaactactgatctatgcatttgtaacaaaaaacagctacagacaataagtaaacaaatgggcatggccatattccaataaaattttctttctaaaaatcaggtgggcttaattcaccaactcctgacctcaagacactggaggacaaaagcaagcagattctagaggggagagtcgatccatggaagagaggaacaccactagatacattttcctttctgcggtttctgctctgaaagcaggtctatctgcgccaagaaagatggcaaaagctacaattaaaagctcataaccttcttggccttaacaaccaggatacaggaaaataccacacccattgggaggtgaggacagaatatgacaaaggagagagccacagagacagggccccaagctctgtatataaattctgtgcaaatgtctgcctgatccatgaaccatgtgtgcacagggcagactccaacagcccacaggataaagacgtgcaccaagattagagctagcaaccaagaaagaatgacaatctgattccaagtaaattaaccggttgctttaaaacaaaatgtatatacctgtgtttaccgtgcttgaactacaaacaacgtggtttaggctaacacacattctcctgagaatctggaacttgggtacatacaaggcagagggtaccttacctacatgtcaggtcccaattaaaaacttgggtgctgagtctctgatgagcttccctggtagacaacctcaacatgtacctcatatcatatacaaaattactttgaaatgaattatgtaagtatacacaaaactaaaactttggaagcttttagagaaaagcagaaaagattatcttcatgatggggttagacaaatggtttttttcataggaatagagaataaccataagaaaaaactgacaaatcagacattatttaacattctaatatcttctgctcattaaaattattactaagaaaatgaatatgcaagccacagagtgggagggatatttgcaaaagaaatctgacaggccaggcgtggtggctcacgcctgtaatcccagcacttcgggaggccgaggcgggcagatcacgaggtcaggagatcgagaccatcttggctaacacagtgaaaccccgtctctactaaaaatacaaaaaattagcagggcatggtggcgggtgcctgtagtcccagctactcgggaggctgaggcaggagaatggcgtgaacctgggaggcggagcttgcagtgagccgagatcacaccactgcactccagcctgggcgacagagcaagactccatctcaaaaaaaaaaaaagaaatctgacaaagaacgggtttctagaatgcattaaaaaaactccagcaacgcagtaataaaaatacaaatttttttaaaaaataagcaaaagacatgcacagacacttcacaaaaaaagatagatggaggaccaataaaccaatgaaaaagttctcaacattaacagtcagcagagaaatgcaaatttaaacaacagtcagatatcattacgtattcatcagcagcactaaaacttaaaaaactaacaccattaattatcggttagatgggcaacagccaacactctcaaacactgttggtcaatgtgtcaaatggtacagctgctttgggaaaagatttatcatttctaataaaactaaatataccatctaccctatgcctcagtaattccagccctacctaataggattgcaaatggaatacacaagttgaggatccctaatccgaaaatccaaaatccaaaatgctcaaaatccaaacctttttgaacattaacatgatgcccaaaggaaatgctcattgaagtatttcagatgtcagagtttcagatgagggatgctcaaccagtaagtataatttcgagtattccaaaatccaaaaacgcttctggtcccaagcatttcagataagaaatactcaatctgtaccacctaataataaaaaggatgaactattaatatactcaatatcttgaaaacgctgaaagaagtcttatacaaaagggtatatgccatatgtggcttcattaatataaagttctacatctggaaattaacatattttgggagataaacaaaatacatattggttacctgggggtacaggtgaatgcacaaagagggaaggggcacaagggatagaggctggtttccacaggtctatgtgttagtcaaatcttatccaatagggtacttaacatttgtgcatttcacgatatataaattttatcttaaaaggaaaaaatgtaaataccaattccagttaatacatatggtacaattttgggatggagtgtattactgtttggaactaacattgaaattcatcaaaaaatgttggattagatagaggaatagataagtggatagataagtgatgaaacatgtttatacagtaaaatattattatagagtctattggtgatgtgggtgttcatattaacttctttcaatctttgagatttttcttctgaaaatactgaaagaaacaatctacataaagaaactgagaccactagacatggacagttgtctaagggcagtggctagttacaatattcggttttcagtttttaccaaaaaaatctgttcatttttaactagtatacttggcttatcgaataaatatgatataaagtaattaaaagttattaggagatctaaaattgtcacgaagtaaaatagcatcttagaaatgtgcacttaattatgacaaaaatatcaacacttttttagagtattctggcaaacatatttagttttttcctttcattttttaactcccacgcaacaccgatattcatatttaatttttaaaaactacaatttctagggacctgaggctaaaagagaaggcggtggtctgtgcagcacagaatcttaaaatggaagttcttaggtctttaagaggtatcctaatgatcaatattgccttcataagaaaaaatattttacagaattttgaaaaatcccataagaaatcataattttatgctactaaagatataatatttattatatgtacttacttgaggaacattgctgtcaacccacttggaatttggtaaaatatcatcccacaaaatcaggcatcgagcaagtgtcttaaaaatgcaacagagataaaattaattagagcaagtaaagttcatacattttataacaatgataataataaacagaacaatttaagaatcagttcccaactgttgagaattttgaaaaataagtatatgcaaatgcaggaaggttatgtactgataaacctattgtaagttgaaaataccttaagctgaaaatacacttaggccaggctcagtggctcatgtctataatcccagcactttgggagaccaaggcgggcagatcactgaagcccaggagtttgagaccagcctggccaacatggtgaaaccccatctctactaaaaatacaaaaattagccaggcatggtggcacacgcctgtagtcctagctactcaggaggctgaggaacaagaatagcttgaacccaggaggcaaaggttgcagtgagccaagatggtgtcactgcactccagcctgggccacagagtgagactccatctcataaaaaaaaaaaaaagaaaaagaaaatacatttaatacaccttgcctgccaaacaacacagcttggcctagcctaccttaaacatgctccaaacactcaaattagcctataattgagtgaaattctctgtcagcatagtaaactgtagagtatgggtcatttaccctcatgactgcatggctgactgggagctgcagcttgctgccattacccaacaccatgagagcatcatactgccaggagtacaagaaaaaaattaaaattaaaattggaagtagtttcttctgaatgagtaccgctttcacactatggttaagttaaaaatcctaagttgggaaccgtcttactcattaaactactcattaaaataaagatttaaattttaacaaagaaaaactaaaattgagttgaatatcaccaaagtttagagggcttgtgcgggtactttttaaaatgtactctggaaaagaaaaaaatcacaaaggaaagaatcatagctctatctacacataatttaaaagcttctatatgctaagtttaaacatcagaaaaaaaagaattagagggaaaattttagacaattaagtgaattgttactttctttagattcaaccttaacagtattatcacatccctgatagtaatccaaaaatgtaaaacaaagcagtaaaaaagtcctaatcacttgttgctttttaggaagttttgaataataatgtgagacagtgaaatgtcactccaagtattaaatatcaacgtggttacctttcttgggattcccaaagtcctatttgtgaaatttcaaatgaacactgccaattagatatgcatgacaaattaaaaataaaaggctctcttgtaaagacatttatgtttgccattcattcattcatggagaacagcctgtgttgcccaggctggtctcaaactcctggactcaagcaatcctcctgcctcaaccttctgaagtgctgggattacaggcgtaagccactgtgcccggcttacaagctaagtttaagaaccacaaatagacttctcatgttaacacaaatgaagacaaagcataccctaagcaagagaaattctggcttcacaaagtccaacaaatacatggtgtcaggggctcggagccaatctgcaatagatctggtggtggaggaaaacagtaaggcacactgttcaagtagagggcaagacaatcaagaatctcaagctctatttcaaaacatttcttcccgctccactacagctctacatatttttcacaatacttcacaccttctaatgtaatagttattatagatgtacatgtatgtcttactataacataaactccatgagggaagatatttttagttttgctcaatgaaatatccccagtgccaaggaagcactgccctacacattcatccaaatagtaaagtaataaatatctatttttaaacactttgttaattctgcacacatttactttttctaaagggagaaatgtggaacactgaaaactccttgaatcttagaatttgtttttaattaatagactaaagacatggcataacgtcttgtactcaacttattcctcatgcaaagtgtaagcataaatgccaaagatcttactttcaagcatcagcattaatatagcaagttaggaaggcagacggtttggtaattacaaaagctcctgaagtaggcaaaaaccattgttttacatggtaaccaagatcacactaaatgataagtatttctggcttaaccagtcctcacagcaatatgctaaattaatgaaaacaaacatgggcattgcttgggtgttactgacatcaactacaaaacagaaatgaacagaaattgaaaactatattgtcaaataccattaaaatagccaaatacattatttccaggtaaaatctttataacttcaaatactgcaagttttctttcaaaaacttacagtacttgaaagaacaaaaaatcagcttaatccagcacaggggaaagaaacacatgagataactgaattttacaaccaaggtcagggaggatatcacactatcaccgcgggaggaagggtgagtgggtagaaatacctgttattggtttttaagtagatcatagccaaagctagagtagcacctggacaagtcacatccacatttatggtatctccttcctattgaaagaagagtttatgcatgtaaaagagttctaaattattataaaattcctctgaataataactatgcttaaaattaacacatttaccaatgtcagtatgaacactagtattttccaattaacttcccagcttccagacttttgatctattactttgctgtgtacttactttgatttgataacttggtgatttatgtttctccctatgcattcctgtttgaaagcgcctatgtcctccaaccatgtactgatagagctgctcaggcacattgagatcagacatacctatcaaattgctgccatgctggaaaagacaataacagacgagtgaaaagaaattttatgaaggaagatccacaacacatacccataacaaatataaaaatgaactaacttcaaagcaggttattttgggttttgttttttttatttccaatttaaagcaaacattaatcatgagttaataaatattaataattctcataaaagttttaatacatgaatgttcaactttaagtactgtcttaaaatacataagagctttagagttagttacatttaacaataaagaaaaatattagttatataattgaaactggaactgtaaatacctgaatactgtcattattgtacttaagaacttttccaacaataactatgataataatagtaatttattaaatgcatgctctgtgtcaggcactattctgtgtgtttaacatgaatgaacagccatatcaaatagctactattaaaaccctattttataaataaggaaagtgtggcacagagggattaagcccaaggttatacagctattatagttaagtcgcagggctatatataaaacacggccatctggctcaacaatccatgaagctgattaagcaatacacaataatgtagttaaatgacttgaatcactagttaggaccagaattcaagttgcaattccctgtgtgattcttttctttttttttttttttttttgagacggagtctcgccttcttgcccaggctggagtgcagtggcacgatctcgactctctgcaagctccgcctcctgggttcacaccattctcctgcctcagcatcctgagtagctgggactacaagcacccaccaccatgcccagctaatttttttgtatttttagtagagatggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctcgattcaccacaacctccgcctcctgggttcaagcgattgtcctgcctcagcctcccgagtagctgggattacaggcatgcgccaccacacctggctaattttgtatttttagtagagatggggtttctccatgttggtcaggttggtcttgaacccccaatctcaggtgatccgatcacctcggccttataactttctttatatcatttagtttgaccataagaatgtattggtggtttttcaaggggaaccacatttcaagtgaaacaatcatttaatgaaacatttctggtaattctgtacacatctcttggatggagttaaagatgggtcaatcagatactgcattttgtcacaaggaagatgctactgggacaacattctgggatacacagtgaacatcactacggcaaaagggggttagggtttgtttcaagcagctactatagactcttaaggctcccgatcatatacgttttcactattctctgttttcagtcatagtgggctgtcacttattcattctatgtcttgaacgctttaaaaaaaaaaaactttattcccttcagtttgttcatgaacactgcaagctggaggaaaagaaatcttaaagtcccactcttgaccacagtttctctcaatttgcaaatctggtactttgaaaaatatccaaaaagacaatagagctgggcagcagattaagtcatagtaagggacaatattcaggtttaggtgtcaacgttatttgtctcaacatgtagatgtcctaactgaagcatgggaaggcataggctatgcttacccccaagcagaccatgcccagggccaagccagcagctaaggagtatgactctctgtcagtgcagtattccatttcaggaccaggaggccgtcctgtaaaaacaaaagcaacacagttcaaactagcttctcaaaatctcatctcataaaaatcttagagttaactttctagcaagttgcactggacatacgaatggaatataactccattcagaaagttatgacactataataaatggtgtccacaactgtaggtttacctaccaaaaaaaagggcccaaaatagttctttttaaattgccaatttaagtctttataagcaatgatattcaaatactgtgaaactttgagtcttaccaaaaaaattaccaagtagtagaaaaaaattttaaagggaaaaaggtaagagtattcaaaaaaaaagttttatttttttgttaaaacatctgggccgggtgtgctggctcatgcctgtaatcccagcattttgggaggccgaggcaggtggatcacttgacgtcaggagttggagaccagatggccaacatggtgaaaccctgtctctactaaaaatacaaaaactagccagggtgccaggtgcctgtaatatcagctactggggaggctgaggcaggaaaatcgcttgaacctgggaggcagaggttgcagtgagccaaaatcaggtcgctgcactccagcctgggtgacagagtgagacaccatctcagcaacaacaacaacgaaatatcttacattttgttttcattactttcaaatccacacatcacatgtggtgaaacatgttcgaatgatgataatgaataaggaggtcacttacttatgttgttaagctgttaaatattatgtttagacatttatttcgagtgtatataataatgagccctactatggtagaatttctgtgtactgatcctagaagtctgactggatacaaaattcatacttttaaaaggcaccctataactctaacactaccgtgttgaaaacgataaaatgtactatgtattaaaacccttccctctgaaaaaatgttcacattcctgaaattttatccctataggaaaaaaatgcaatttaaaaaaaaagaaaaaaggctggacgtgctggcccttgcctgtaatcccagcactttgggaggccaaggcaggaggatcacttgaggtcaacgagttcgagaccagcctgtccgacatggagaaatcccatctctactaaaactacaaaaattagccaggcatgctgacagacacccgtaatcccagctacttggtaggctgaggcaggagaattgcttgaacctgggaggcagaggctgcagtgaaccgagatcgccccactccactccagcctgggtgacagagcgagactctgtctctaaataaataaataaataataaaaattaaagaaaaaaatcacacaaaggtaatcagtgtaatgtttatatataacaacaaaggattattagaaacaatctaaaaagttctaaaagttaaaaaaaggcattttacagaccatcgactcaatgaatattacacaaaatttgttttaaaacccatttataacaatgatctataaaaacaatttttaggcggggcacagtggttcatgcctgcaatcccagcactttgggaggctgagacaggcggatcacaaggtcaggagatccagactatcctggctaacaccatgaaaccctgtctctactaaaaatacaaaataattagccaggcatagtggcgggcgcctgtagtcccagctactcgggaggctgaggcaggagaatggcgtgaacccgggaggcggagcttgcaatgagccaagattgcaccactgtactccaggctgggcaacagagcaagactctctcaaaaaaaaaaaaaatttttaatgtacattctgacagtaattatataaaaaggcatatacatatgaattaaagatgaaatcttctatatacagtgtgaaagaggtatgccgcagctgtgagactgtgcaatgacaccattagacatcatcatgatatagccaaagaagggtagactactttgcagatgaacatgctttaacaaccagtgttgaatattttcagaataagcgtttttcagatctctgacttatgctaccatgtattgtgatagccaaaacatttcaactttgggaataatttcatttatcattatagtagactaaattatgggtcccaatcttcactggttctctcttaggtttctatcaacaccacgagagaaacacaccctccagcctgggtcccagaatgaggcaggtgaggcagaacggcagcagaacagccggctacacatctacagcctaaagcagagctgcctgggccaatgctatgcctgtatgtatgtagcatcactgtggcaatagctatctgatacaattatactaaagaataatacatctttaacaatatattcacaaatccatatagaaaagatcttgaataggacatataagtatgtaactaaattgttgagcatattaataatgccaatagcatttccatttggcagaaaaagatgacaacacataaagatttccaaaaagtttggacccaataaaaaacagagacaatgttcactaaagtgagtgtgtggaccttaccatttccaggttcatcaccaacatacccaccagcatgtaaaggaggaaagcaggagtccattacttgacttctattggaagtgctgttatccaacacagtaaacactgtgatgtgtttagtttagtgtctctcagggaccaaaacaatctactctgagttttaagtgcaggccactggtagacactgctggtaaagcaggataaacagcatactcatagctgattaaaaccacaggtacctcattaaatgtgaccactggaattcagtaatgagctagcaaataaacatggaggttaataacctgcagttacattagccttggataacattacttagagttttgttgttttttttaattagtactagatcattctttgctcataaaagctaccattgtctttccttaatttttataattttactatcacttttaattgggttaatgtggagtggagagtacatgcctatgaagattcagcactattaatcccatacctatctcagccaacaggacttctgcagtatgtctgtgagctgtcccttgatatacaaggccaatgccaaccactgcagccacttggacattgtgaggaacatccagctctgtggacgttgggggtaagagagcaggaatgtgaatgctaagaagccgagtaatagacatatccatggtgcctagttttgcagcagaaacaccaagtagcagtccaatgcttgtcatttcatggccctaagatagaaacaaaacaaatacatagtttaaaataaaatactgcctgccactttcaagaagtacttttatgttgacaggcaaggtgagaggcactgagaatacagcagtaaactaaacaaacatggtccttgctctcatggacctaatgacttaataggaaaaaaagtgttaaattaaaaaacataaacaaatatattattaaaaagtagtacaataagaaagtacaaagtattatgaaagagtattttaaaatagcttaatttagattgggagggactagaggattattagggatgaaatctctaaagattatacaaagaaatttatattaggacctgaaggatgaaaacaaattagccaggaacagtggcaggaaagaggacactcaagtttagaaggtgaggaagactgtttcaggtgataaaacagcatgtaaataaatggctctgaggcgattcagaaataaaccctcacattaacatcaactgaccacaagggtgccaagacaattcaacaggtaaagggcagtcttcaaaaaacagtgctgggacaagtggaaggacacattcaaaagaatgaggctggactcaacacaatataacaagtgttggcaaaaatatggagagattggaactctcatgtattgctgatggggttgtataatggtgcagtcattatggaaaacagtttacagttcctcaaaaagtttaacagagttaccatataacccagcaattccactcctaagtatgtaccactacttaccattacttcattactcttgagtaatgaaaacatacatctgcacaaaaacatgtatacaaatgttcatagcagtattattcgtaatagctaaaaagtacaaataacccaaatattcatcaacttatgaataaaatgtacattcataaaataaaacatttattcaacaataaaaaggaatgtattgctgatagatggtacaacatggatgaaccctaaaattatcaggctaagtgaaagaagcccatcctaaaataccatattttatatgactccgttcacatgaaaggtccagaaaaggcaaacccatagacacggaaagtagattagtggttggcaggaagtgaagtgaaggtgggggggggtgaggtagaggaatggggagtcaccactagtgggtacaaggttcctttatggggtgaaaagatgttctaaaattaacagtggtgatggatgtacaactctgtgaatacactaaaaaccactgtaccacatactttaaacagtgaattgtatggtatgtgaattttatatatttatataaataaagattccttaaaaaaaaataacgctgtgaagtgaaagagtttagtttgccagagagctaaaatagccaatctgtatggttagagtgtgggggagcaagaagagtggggctgggtgcagaggctcacgcctataatcccagcactttgggaggctgaagcgggcagatcacctgagatcaggagttcaagaccagcctggccaacatggtgaaaccctgtttccatcaaaaatacaaaaattacgcaggtgtggtagtgtgcacctgtaatcccagctactcagaaggctgaggcaggagaattgcttgaacctgggaggtagaggttgcagtgagacgagatcacaccactgcactccagcctaggtgacagggtgagactccacatcaaaaaaaaaaaaaaaaaaaaaaagaacagtggtaccaactagggctggagaagtgaacaggatcacaccagctcctagaatgtatattaagagcaatggtcgatccccctttgccctctggtgttgggaatgttggccttgttctaaaccagtttcccttcacagaagttcggccatcatgtgggatcagaataaggtcctggggcaactaaaggtatctggccaagggtacatccgaaggaccctacaccggcccccagtccccaccagcctgttcaggtgtcggacaaagacttccaatctttcctatcatgtttttcctactgctcttctgagaaatgttacttagttatgtgtctctttgagaaattgcttcttttcagggcaggatgctgggttatgcttgatgaagctaaataaactgccagccagatgagaattatagacaaataatatgcagggaccccccctggattcatcttagtcttgagctcatatagaattcagagaaatcaaaggcagttgacaaggagggtcaaggctgagtgcaagtgaacgcaactactcctgctggcttgatccccccctggtcatgaatggtggctgcgcgcacatccacgaccaaggcaagcctgagagacgccttggactctagcacagcagagggaaagactaaggatgcctttttctcccctctctctttctaaatgggtagcctgcactcctctcaagtgcgagacattgggactcctttgatcctcagactctgaagaaaaaatacctggtatttatcagtaccaaggcttggcccagctagaagttggaagatggggagacctagtcagctggggaaaataacaactataatactatcctatagctagatctcttcaaccacagagaaggaaaatggtccaaaattccatatgtataggccttttttgccctgcagaataaccgcaagctctgtcagcaatgtataatagaccttgcacttatagcagtgatatccagccagacttaatccagacagaagggaaaaaacagtctgcctccttagaagaggagacagaggcccctgcaccagcccaggtcccagctcctcttggatcatctcgtcccccttatccaggcccccttttgaacctcatcctgttagaagagttcgacctggatgcgctccagcatcacttcttcctttacaggaaatgcatagtgaatatggtcctatcaaagtacaagtccccttttctttacaagatttgaggcagataaaaagaaatctaggacaattgtgtcgaccttgataggtatattgaagcctttcagaaccttaatcaaatgtctgagctttcatggaagggtatcatgttacttctcaactagactcttagagcttcagagaagcaggcagctttacaggtcactgagacatttggagatgaaatgtttatcttattatggcacctaccaaaagggggaagaaattagggagccctttctgacagccaagcaggcagcatccaccaataatcctcaatgagactcagacactgctctaggaaagtggccgagaaaacatttttagggatgcacagtggaagatctgaaaactagaggcaaatctctcaattacattaagttatcaaccataaaccaagggtctgaagagaacccttctgttttcctggaaaaaactgagagaggctttaattaaacacccatctctctcctgactctataaaaggatagttaattttgaaagacaagtttataacccaagcagccccaaatattggaagaatgctgcaaaaagttagctattgcaccagacagtactctaaagaaaatcctgaaagtcaccaccttggtcttttataatcgggaccatgaggaagcccaagaaaaagggagaaaaggaacgagaaaaaggcagaggcactaatagctgccatacaggcatataaacctctcaatcccagggagcttctcattctatgaccggctgttatcagtgtgggagcactaaaagagagtctgcccccgaaatcagaagcagcccccacggccctgtccaatctgtaagggagactactggaagacaaactgcctccagaaacatacgtcccaaggttcagagccggcttctcaaatggtccagcaggactgatgggtcccagggctctcctccccagctctgacagcccaggctgcattaccatccaggagtcccgggtgagtctggaggtcaaaggactcagaggacagacttcctactcaacaccagagcagccattcctgttctcctctccattctgggcctcccctcctcccttagcacaactgtgagggtcgtctcaggaaagcctctgactcgatatttttctcaatcccttagctgtacctagggagacctttcgtttacctatgcctttttaatcatacctgaaagcccgactcctctgaggtagggatattttagctcacatgggaaccaccatccttatggctccattatggctccaggacagactctttgcctccctctggtggagactgatattaatccagatgtttgggcaattcaggaaaatactggctgagctacaacagtctcaccagtccaaatccatctcagggatctcatctccttccctaattaaagacaatatcccctaaaaccagaagctaggaaacaactagaagccatcattaataacctaaggatgcagggccttgttaaaccctgcgacagtccttgtaatatcctaatattggaagtacagaaagaaacccaacagggaatggagactggtccaggatctccacctcctcaatgagtaactggtgtaattaaccaatttacccagtggttcccaatccctatactttgttaacttagatacctgaaggaactaaatggtttgcattcttggaattaaaagatgctttttttctgcataccattataccccaactcccaaaacttgtttgcattcagggatccctccaaccagactacccagctaacctggatggtgttaccacagggattccaagacagcctccacctgtttgggcaggcaatctcaaaagatctctctgagttctttcaaactcaagttagtcttaatatgtagattacactctactctgtgccccaactgaggaaatttctcagaaaagcaataaggctcttcttaattttctaactgacagaggacataaagtttcaaagtccaaggctcaactccgtcagacttcagtgaagtacctatgcctggtcttgtcagaagggaccaggacactgggcgaggagagaattggatccattttctccttccttctccccaagaccctcagctaactaaagggattatcaggcattactggattctgcagcctatggatcagaaatctaattaaaagcattgcaatgcctaattataacatatctaataatctagggggacatgcccatgacaaccctattttgcaaaatcctggaatagaacagtccattttcagaggttttcttcctgtcctttctaggtgtccctaatatatgggcatggattttcccccttttagttcctctttgtgttctcattgtaatactcatatttggtccatgtgtacttaacctccttgtaaaatttgttttttctcgcctagaggccatcaaactccaagtggtcatgcaaatggaacctcggttgatggctctcttttaccaggggacacttagataggcctctaagagagacctgactgctgtttcccaaaacaacaccctctgtcagcatgaagcagaacagtcatcacccctatccgaacagcagttagatatacctcttcagagcggggattgatggcggtaggaggcaggtaaattctcagatgaaactcaaccttcaagccaaggacagtcgaaagcctgaaaaccaagctacaagttctggataaatccatggactagagagctctcattcctgtttggcatgctctctcctgattggtccttatccttcacctaccttacatatacctgcccttccccagttggtcctctacactatcgtgcctatttctaaatggtgctttttcaagcatacccacagaccaatcagcatgtacctcccccatttcaagcccataaaaacctctagactcagcctcgtggctggcaacccaccttcgggtcccctctcgctgttgagagctttcttgtcactcattaaattctactctgccttactcaaggaaaaaaaaaaaaaaaaaaaagcaatgggagatcattaattaaatggctttgaccagggaagtgacatactctgatttatgctttagaaagattattccatgtactatgagacaaatggacttagaagtacaagaatgaagaaagaagagcaaatagagcaattaggagctactacaatagccagccaaggcacaaagccaggcactgggagcacaggtctcaccttggtcaagtagtcatggatattgagagtcgccagcttggtaaggtgcccattcaaacccagagccatgagaaagccagcatactcattggccaactcagcatgcttgggcttattgtaaacaatccaagctgagtcgatctgggaggcaggagctatcttcaggccagcagccacaccattatgaaagctggcccagcttgtcatgttgggaggcacatcgatgtttccactattaaggtctactgttgtgttccgaggaggggcacgccctatccagccaaacgaagaacattgagagaataaaaatccacaaaaccaagattgttaaatttagatctttgagactaagattacttacgttttctacattcaaaaccattaaccccataatgcctggaacgttaggtctctatgaccacttaaaacttttgtacatgtgagtcaaacttaatggaactggaaaaaccttcactgtctaaacagttcattgtcctttttgttaaaatgtatgaggctatataatgagataactgataccaatttaacattatacagagatgactgggataatcactcattttttctttcaaacagagagcttaaaaaccaaaatgaagactaacatcactgttaaactatacaagttataaatcccaacatctgatgacactgatgttaatttcaaatgttctatcctatattttcccctagacattaaggaaaaatgacatcttaagaaaagacaaaagccaggcctggtggtgcgtgcctgtcccagctacttgggaggctaaggcatgagaatcacttgaacctgggaggcagaggttgcagtgagccaagatcatgccattgcactcccacctgggcagcagacagagactgcatctcaaaaaagaaaaaaaaaaaaggaaacaagaaccttaataaatctgctacaggtcttacctatatatgcccccttctctctctttttttctctctctctctatatatacatacagatatagatatctaattatatgctatcgtttaaaatgcttagagatagttttgtaaaaagcatccttttatagacttgagtcacccagtgaacttcaaaagggcattcaccagattatacttttacggtccatttatttaagaacaatgtaaattatatgttcacaatgctatatgttccctacgaattttttcttgattcttttctttttgatctacattatacacagcaaacattgaatctttttaaatatattttgaatattgtcttaagtcacggataaaataattaacataaatattttaattactgcataaagttatccatttcactgcagctttaaaaataccatttttaaagagttctaagatgttatgtaaaataaattttaagtagatgcagtgtcttatttgtagcatgtacacatacacacacaaagcacaaagtaagacttatttgtctttactatatgctttttgtacctaaaagctaactcaactgctagtgttagcaccacaatgagtaataagttcataagttacacttgtactttctcaaaaaaggcagacatatcaatatgaaaaaactgagtgacctttctgaaacattcattcatcatatgcaagagacataatatttatacacgagagaaaataaaatgcaaagggtaaggtaaattttcttcaatgagaataacaacatacaaaagtacaacaggccacatcagtgtgggttaagcaactatttaagaaaatattctttcctaaattaagaggataacctttctttttggcctaccagaatgactaaaagaataaaatgttggattaatgtcataaacacattttaaatcatgcaaattcaattaaatgtattcagaaaaaaagatgcatgtatatattttttaaacccacccaagtatcacttgagtgctaaatcacccagattgaatacattttaacatttgccaattttgcattagattttctttttaatctgcacttattatatgaaatctttcatataaacagttggaaagactactaaaatgaacatctatataccatgccttccatcaagaatcaataattgttaaaattttgccataggtgctttacctctgagacaatttaaatattaaaagcaactctgctcactatgtccctcagtgagatcagggctcagaataagcatgatatggagatgggaatgtgttctttcacttagtcaatctcatttcctgcatgctgctcaaagcacaagcttttcacaaatctgagtggaactctggattttttaaagtatgcaatttaaaatactgtataattatgtttgcatatattatgtactatttatcatatattaaattatacattatatgctaccacatatactatacactcctacaacatacattatacattttgtataggtttcacaaaaccatatatactataatagagtttcagtgataatttcaactatgtaattgtcacctttagaacacattcaaatcagcattagggggacatgcactataaaattcattgtaatcaagactataactacagttatatatggcagaaataaaaacttgtgccagccagaaaggcaatttgacatgttccttaaaaccattcatcttgctgtcctaagagttctacttctaagcatttagcctaaatacacaggacgaatacgccccaacaatgtttataataccaaaaaactgtaatttccaacaataccaggctgcttctataaactatggtatatccgctgaatgaaatactctgaagcaaataaaaatgaatgtattgattaaaaacacgtgtatacaatacatacacataattataaacacatacatttatttgctagatataaaaggatgttcactgtaaatttttaaaaaaatctaaaatagatataaattttctgataattaaacaaatataaaattataaatatgtggaaataaacttagtaaacatatatactaaaatgttaaaaggagtgatgcagaagagtgggagtactgcaagcgaccattgtttctctttttgcttagtacatttcttgatttatacaatgatcatctgtttaaactatgacgtaagacattttaaaactaaatatttttacatattaaacttaagattatttaaaattcaagtctcatcgttatcaataatatctttctgaacttctccaagtgactttttagatcttaaaatcacctcattaaaaagcaaaaatgagtaatgaactatattctgcttctctcaaagtttagtttcacatggcatttgagctttgataaccactacagcagctattaggaaaattttaaatcactggggatagagggagcatttcttttgttttaactaatttaaagaactacacttaatgcatgtacttaatcattttcctttctcattgagcccagaatttaacataccagtcagattcaatttaggaataggcaatggctctgttggaacaggatggtacgaaaacaaggtaaacattcctcgtcctacaggaagagccatagttcgctgacacaattggagcaatctgtaattaaagtaaaaaccaacatatgaaaatgtttaaagcaaagagcaattgaaatatcatctgtaagtatttcaaaagaaggtgtactgtataagatgaagttgtctcaaagtaaattcatacacagatgtgagtgaactacccaaacatgattattttcattttaatattcttgttcctattacactcttagggagagacatatttcctctgttttgtttcatatttacattgaatgaaaaccacctggcctataaacccagccgactctctctaggcattcaaaaaaaaaaagaaatttaaaattccactccgatggatgctaaccttctcaaaggaaaatacagtacttttggggtttttatcactgtgttaatttcagtctagctgtcctcagtacatgtgggatcctcctcccatcccttttgccaatacagcctcagaagtaccatttctgtggcctgtacacaagaaaagaaacaaggtccttgtgttagaggtgaatggatttcatggtgtctccaagggaaatacagattggtttcacttacatgatggctagatttataggactaataccattatgtatcaggtatgttcaaggttaaaatggtttctgttggctctactgtgaaattaatacaccactcttcaacttcttcctatgttaaaatagcttaacattccatatagccacttaaaaaaaactaacagaaattttggaagtagggcatttataactaagaaacgcctatacaagctatatctgaagacacagaaatatcccttcagaggctgacaactgacaaacattttctctgcagacaaagctattcataagcatactccctccttaactggacacacataactgcttttctagctaactggaaagaaaaattttgctgtcttaaagattctctgggaacacaaccgcaacattaatttgggatcaggaaaattcaaagccaagaggctgttgcaacccatagaatttttttagaggaaatcttacacataattcacttcaactttgcgcaagtaacaaaattataatgagaacaatattatatcccctgaatataagatgccactgataagatgtatcattatttcatgagaaactaagaaagaaaaagcactgccaattaaactatgacacctgttcactgaaatacacaactgatttcagagatattaaaaagtgaaaaaacttgcatcttagaatcaatgaactctactactaataatggctgactgcactgagctttactatgtattgagcagtattctaagtgctatgtaaaaataattcacttgatacacagcaccatcccatgaagtatgcctacttttacaaatgaagcaactgaggcaacaagaggtaaagtaatttaaccaaagtcacccagcacagcatggccatgcctggctctagaggccatgctcataaatcctatgctctaaactcaacttctgtcactccatctttttattcacaggtgactaataactgggtacatgtggagaggaaacagttaatagggaaatcacaactaattcagatcttcagcagcctgtggctaagtgtgggtgatggttcccctcaaaacagtaccataaaaaaagtaaagagaactagaaaacagtggcagatgaatgatagatgatagagacaagcagataaaagaacaggagagaattttaaaacagaagtgtcccaagagaatagctctggaatgtcataggcatgtgagtcttataatgtatcaagggatgtatcctgtgcaggggagtggcagaagaaaggcttatctatttttatttggagtatcatctatcatatccaaaaaaaaaaaatactcatacaagtttaaactacactaaaaaccccactaacctcaaaatctattcctgatcaagacacagaaaaacaagtccagtgttttctttgtttgtaaattcttaaggtaactatcaggcaaaatagttttacattcaccttttctaaagagtaaagtgttatatgtatttcaagaggaggacgatatgaaatacaacaattacgtcctcaaaagccaaagacattttgctaacacacgtggtttgttgaagttggatgaaaacttaaaacacagggcatattttcacttgaaagtatcttttaaatctctttagggttttaaatgctaaaaacttgaaggaaaaacaaatatacacaagacacaaatgtaacaatgaaacatgacaagagatagtgcacgtgttttctttcacctgttttccttttcctcgatgaactcgtggtcactgagctctgggtactgcactacgttgacacggacaggatgcgcactctgaagaagccttcgcacatcctgcacccttaaatcttcactccatattaatgacatgacctcgtgattcatgtcattcatgccgtcatcttcctcctcagtttctgttcctgaaggaacatctgatgagagcacctgagtaacagactttattgtaataataatttcaaaagcagttaacatgcacttgctgaacatgaggatatataggctgatgtgtcttgactatactagcacagagaaaatatgttttccaaagcaggcatgggttggagccgcaatgtatactgggactctaatctacaaatctttctaaaaagtactatattgctggccgggtgtggtggctcacactctgtaatcccagcactttgggaggccgaggtgggcggatcacccgaggccaggggttccagaccagcctggccaacatggtgaggatgatttaaaaagataattggagagtaatgaaataatttaactttctacttgcaggattcctagaactcatttgaaaaaaaaaacagacttgatgattgatgaaagacagtatttcgggagggatagcttaagacatgtttttaaacaactctactgaaaaaaacacattttttccctggggctgcagttttatgtgattaaacaaatatgtttacacctatttaaaaggttaaattcaaaaaattcaacacatcaaaaaatatgcagtagaaaatatttatatataattactcatccaaattcaggatatatgtgctctcccttttcctatgtaataattacaaagtggttaattactaatatggtacaagtagggaaatagccatggtagtttccatgactaccctcaggacttgtcctgattcaaggcaaagaaagatccaggcacaagacagaacattcacaaaatctcctgctcctaatgctcatcttaacaattaataagacgcgtacaattacaaaccccgtctggcatataatataaaagacaagctaatatatatacttagaaaaagccttaaaggaaaatgaagaacatttctactttatgattttatttaaggctaaaattggaactctgaactttctatgttgatactcacagacttccctttgggtaagtttccttcgcaggcctgcttggaaagatcctgacgtccaatcaagagacagacagcttctggccagtctgaggcaggctgctcacgacagtgataaattgcatctctgatgggaagagcaattccaaagggaagagtttccaaatctcttaaagtgaatcctaatggttaaaggaagagagaaaaattttaatttagactcgccactgtcccaattatcctgactgaagttggcaacaatatctatcctgacaaataagttcattttattcatcttactaccagactaatgtcttgacatcaaggactagtataggaagtctctttgaaagaacttgtaaaaacctgaagaaaaaaagacaatctaatagaaaaatataaaggacaaaaagacatttcctagaaggggaaacataaatgggcaacatgcatatgaaaagatgctctacctaattagggatcaggaaaatgcaaattaaagctactgagaaatataaatgtcaaagccaatcaatactaaatgttggcaactatgtagagcaataataattctttttattctttttttttttttttttttttttttttgagatggagtctcgctctgtcgcccaggatggagtgcagtggcgcgatcttggctcactgcaagctcctcctcccgggttcacgccattctcctgcctcagcctcccgagtagctgggactacaggcgcccgccaccatgcccggctaattttttttgtaattttttttttagtagagacagggtttcaccgtattagccaggatggtctcgatctcctgacctcgtgatccacccgcctcggcctcccaaagtgctggcattacaggcatgagccaccgcgcctggcccaagcaacaataatgcttatccatagccaatggtagtgtaaactggtacaaccactttggaaaacagttggtatgtataggtcaatccacccatttgatccatcaacagccatatagaaacttatacccatgtacaaagacacaggtataaaaatattcattagcaatactggtttgttatggaaaaaaaaaaagagatggagaaaggggtgagtccgattgtctatcatcaatagaatgggtaattaaattatgatatgttcaaacaaagtaatctctatatcagagaaaatgaatggcccgctgctactgctacatgagtcgacatggatgaatctttaaaaaacaaagttgagtgaagaaaaaggaacacatatttacatctatatattttcaaaactacataagacctagcaatttataaagatgtaaaactataaagaaaaacaagagtaaggtaacacaaatgtaggtagggcagtggttcactataacattggggtgtgtgacaggaggggaccatccaagaacagatatgtaagggccttctactatgcgggtaatattctatttctaggggtgggtgaccagtacatcaatactcactttagtaccattctctaaactaaacatatacgtttgacatattattttgtaagtataccatatttcatatttaaatttatcctcaggttaattaaatcatgtttttcttatgattttctaaatttcataatactatgcattatttataatataaaaagtcgattaactattgaggcaaaaaatgtttccttatatgagaataacacttattaaatattatgcaatatacaaatggatagaactaatccaatatttttcagcataggtatcctgtatgtatactatgcaacagttattgtcatttttaaggtaaaatgcaaaaaaaaaaaaaaaaaacctgtcagaaacttcatttagaacatactttagataagacttcaaaaacatcttttaatattcattaaaactttactttttaacatacatcccatataacatcctcatttttaaaatcatgtcttcgtggcagtaatttttgtttttcagttctttgtgaaaaaaaatttctttggtattttacttaatttaaaacctaggagcataggtttggggaatagggaatatagaactcttttccttcctcttcctcttcccagttcaatgttcatcttggtgcctgaaatcccttcaaaagtgcatttatccttcaaaagtataccctgaaatgtttatattattgcttttagactttgccaaaaccacccatttctgatatctgagtatcacaatgatttcaggtgtgtatgtaggtgattagagttctccattctcagagaccagcttacatagccacagcctcaaatgttccaattaaatggcaaataaagattccttatgcatcaagataaaaagctggtatcccaaatattattatatgaaagttgtgagattgtcgagaaaaaaagaatatggcttgatgaaccataatctcaatcttgtgaggccttttcacaaagccagagcccctctctcctcatgccttccacttctagctagtctggaggaagcacggcctagttaggaggtaacaaagaagctctcacctacattagtcatccagacaaccaatctttcagctagactagaaacagatgtagaatgcctgaaactaaacctataagagaataaaacataaagttattaagcagaacagtaaataatattgttttaagtgtttgacataaaagcacagtctaaataaaagtcacctgttttcctcttgttctacttgcaacttctggggggctaaaaggcaacaaaatgaaacttaattttgatagtcatcctggtaaagaaaacatgtaacatgtagaaaacatttgaaaataagaatcaattagcaaacaacatctaaaaaaaaataaaataagcaatactgtggcaggctgaaaagtacagtcaaggccctcagaatactcaggggattggttaggacaccccatgcgtacccaaatccgtgcatgctcaagtcctgcaactggccctgcagaacctgcatatgggtttcacatcagagaatactgcattttctatctgcatttggctgaaaagaatttcattgtaagtggacccacacaactcaaactcatgttgttcaagagtcaatggtacaataatttccttcaggctaaaatagtcctttttacccgcactgaaaatacaagatgtattagattttaagtaatcctgatacctgaaaattagttgtggacaaaagaccgcaacagaccagaacagtactaaaaaggtaagacatggccgccaaagcaaacaagaaaaattcaattcttttttcaattctgatactgacatttacaaaaatttgtttccagaggcaacattgcaccaacttacctatagttattctggttaaatactgtgaggattcatcagaaaccaagctctcatcaccaagtatgtacagtgcaatactctgcaaaggaagaaaattaacattatttttctcttttcagagacagcatctcactttgtcacccaggctggagtgcagtgacacaatcacagctcactgcagcctcaaactccttggctcaagcaatcttcctgcttcagtctccagagtagctaggactataggcacacaccaccatgcccagcttattattttatattatttttattttttgtaaagacggagtctcgctgtgttgcccaggctgggctcaaactcatgacctcgagcaatccttctgcctcagcctcccaaactgctgggattataggtatgagccaccacacctagctacataattgaagtataactagaaaataattataacatagaataattcatccattttaggtgtacagctctgtgagtttcgacaaatgttgtatcacataaccactaccacactcacaatatagtatactttcatcacaccaaaaagttcccttgttccttttgtagtcaatcctttcctcctacacccagcactggaaacaattcatctgttttcttgctctacagttttgtctatcctacaatatcatgtaaatcaatcatatgatatgtagtcttttttgtgctacttctttaacttagcataagtctttgagattcattcacgtctctccaaggatcactagtttcttccttttcatgctaagtagtattccattatacagacataccaaactttgtttacctactcaaaaactgatgaacatttggttccagtttgtggtcactatgaccaaagctgctttatttatttatttattttttttttttttgagacggagtctcactatgtcgccaggctggagcgcagtggcacaatctcggctcactgcaacctccgcctcctgggttcaagcgattctcccaccttagcctccagagtggctgggattacaggcatgcgccaccacgcccagctaatttttgtatttttagtagagacagggtttcaccatgttggccaggatggtctcgatctcctgacctcgtgatccgccctcctcggcctcccaaagtgctgagattatgccaccgcacctggccccaaagacattcacatacatgcgggtctttatgtaggcatatgttttcatttatcttaagtaaatacgaaagtgtatgtttaacttcacaagaaactgccagttttgcaaagtgccatgccacttttgcagtcccaccagtaatgtatgagagtttcgattgctccatatcctcaccaaaagttattttcagtcattccaacaggtatcgaatagtgctctctcactatctaagaagtatctagtagtacagagctgtagtgttatttgctttgaagaggaaaagaaaaagataacacaaaggaaaaagtctctcaaaagagttaaaatattcaacatataacacaaacacaaaagtacataagatctctctattaaatgagaaaacatacataaagttccttgaagacaacaggctcccaataaatgttatctcacttccttcctttccctcatttcaacaaatggtacacagacaatgccatctccgcatatacaagtgactcaatagaaaaagagccaccataagctagaaggttactacaaatgtctcattagctaaacatcacataaaaaaaatttatcacttgcggtcaggagttcaagaccagcctgggcaacatggcaaaaccccatctctactaaaaatacaaaaattagccgggtgtgatggtgtgcacctgtggtcccagctactcaggaggccgaggtggaaggactgcttgagccccgggaggttgaggctgcagtgagccatgattgcaccactgcactccagcctgggtgacagagtaagaccttgtctcaaataaaaaaaataaaaaataaaaaaagtccaataaaacttataatgaggaaaccaaaaacgtatcaacaagggcttctgttgatatttttcagaatatttttataaataaaaattaaattcatatttttataaatagatctctgagctaacaagttataaaggaatacgaagaggataaaactaagatgaaaggccagagaggtaaactgagcactcatgacagttttactgaaaagacattcacagaaaaacctatagaatgggagaaaatatttgcaaatcatgtatctgacacattaatatctagagcataaaaatgcctaaacttgaaaataaaaatccaattttcaaatacacaaaagatctgcatagatctttcttcaaagaagatacgtaaatggccaataaacacaagaaaatatgctcaatatcactaaattaaggaggcaaatcaaaacaatgagatatcacttcataaatactaggatggctataatttttaaaaaaacaaatagaaaataataatatgtgttggcaagaccgtagagaaattggaacccttcctcttgcattgctgataaggatgtaaaatggtatagccactatgaaaatgagtttagcagttcctcaaaaagttaaacatcgaactacctaccatatgacccaacaattccaccaccaggtatatattaaaaagaactgaaagcagagacttgaacagatatttgcatacccatggttcacagcagcactattcgcaacagtcaaaaggtggaaacaacccaaatgtccatcatcaggtgaaatgataaattgtggtatatccatacaatggaatactatatagaatactgcctttaaaacaatgtaattttgatacatgctacaatatggatgaacattgaaaacattatgctaagtgaaataagccagacacagagagataaatattgcttgattcccataacatgaggtacttacaagagacaaattcataagaaacagaacggaattaccagggcctgggaggaaggggaatggggagtcactatctaataggtacagagtttatgttggggatgatgaaaaagtcttgggtacggacagtggtgatggcaacataacaatgtgaacgtattcaacgccactggattgtacactcaaaaataatttcaggccgggcacagtggctcacgcctgtaacccctgcactttgggaggccaaggtgggcagatcacctgatgtcaggagttcaagaccagcctggccaacatggtgaaccccatctctactaaaaatacaaaaattagccagacttggtgactaacgcctgtaatcccagctactcgggaggctgaggcaggagaatcgcttgaacctaggtggcggaggttgcagtgagccgagattgtgccactgcactccagcctgggcaacagagtgactccgtctcaagaaacaataataataacaatttcaatgacaaatattatgttatatatattttgctatcattaaaaaaatcccgtgttttttaaacagaaacatcattctgtatgtctgttttggagccatgggggggactgtgaagcacttctcaccatgaagcagagcaaaatgtagagtaaagaaaaagaagggcagggggcaaagacatttacagtctgccaacatttgagagaagggacaaaagcatatggttctcctgcaagcctgggaagaccccacctggaaaggcccacaaggggcctatgagcaggctgctccaggatggggggactgaggaacaggtatgccaagaaacttaccttattcaccgttacagccctatggttctatatgaaggtttgatcttggacatgtattaaccagtaataacaaactaatttctaaaaataaataaatcatgagatttgcagctagaggtaaacaaaaaataataaaaataaataaagaagtgtttcttgaaaaaaatttcaacaggatttttctttgtagctatagacaagctgattataaaatcagtatgggacgggcacggtggctcacacctgtaatcccagcactttgggaggctgagccaggcggatcacttgaggttgaaagttcgagaccagcctggacaatatggtgaaaccccgtctctactaaaaatacaaaaaattagccgggcatggtgtgggatcctgtaatcccagctatttgggaggctgaggcaggagaatcgcctgaacccagaaggtggaggttgcagtgagctgagatcactccactgcactctagcctaggcgacagagtgagactctgtctcaaaaataaaaataaaaataaaatcagtatgaaaaggcaagaagagtaatgaagggaggagtaacgctaatcaattttaaagacttactataaagctacagtaattacagcgtagacagccacaaagatcaatgaaccagaatagaaagtccagaaacagacacacaagaatgtggccaaattaacttttgacaaaagtgcaaatgcaatagagaaaggatagtctttttaaaaaacagtgctgaaagaactggatatccaaatgaaataataaaaaccttgacttaaaacctgacatgttataaaagattaacaaaatggattagagatctaaatgtaaaacatgcaaagaaacccaggagaaaatcttcaaaacctgaagttaaacaaagaattattagacatgacactaaaagcaacatccattaaagaaaaatacagataaactagcttcatcaaaattaaacacttttgctctttgatgtattaagagaatgacgagacaagacaaggtagaaaccagaagaaaatatctgcaaaccacatatctgacaaaacctcatacctagaaccctgaaaacatcattagccattaggaaaatgcaaattaaaaccacaatgaggtataactacacatctctcagaaagacaaaaataaaaaagagtgacaataccaaacaccaacaagaatgcaggtaaatgatctcttaaatattggtggtaaaaatgtaaaatggaagagccactctggaaaacagatgacagtttctttaaaaacaaaatataaacttaactatatgacccatcaatcctactcccaggtacctgtcctagagaaagcaaaacttatgttcacataaaacgctaagcatgaatgctgacagcatctatatttacaattgctaaaaactgaaatcaacccaactatcttgaatgaaaaaccaactatggcacattcatgcaataaactactaattagccatagaatgcgatgaactgtcgatacaggaaacaacttggataagtctcgaaatcatgagagaaatttttgagggtgatgtaaatgttctatatcctcattgtagtaattacatgaatctatacacgtactgaaattcacagaactatacacagaaaaaaacttaatatcaggtgtactttttaaaactaaattttaaaagaaaaaggagataggtagtaacactccacatacataccaagactacaagtctgcttctttcacagattccagggaggtaaggataaggtggcattccttcacccttcagacaagaactcacccactgataaatacttggtggctcagacgtaaaaaatgatggatgatgcataaatcctgtttgacctttaaaattagataaatattcaaaaagacacgaaaatacattaagacaacattattttattttaaacggaagatgatcaacagttacttgtcattttgaaacaactagaataatatttttccagctgggtgcagtggctcacgcctgtaaccccagtactttgggaggcccaagcaggtggatcacgaggtcaggagttaaggacagcctggccaatatggtgaaaccccgtctctactaaaaatacaaaaaaaaattagctgggcctagtggtgcgcacccgtagtcccagctgcttgggagactgaggcagaagaatcacttgaacccaggaggtggaggttgcagtgagccgagatcacgcctaagagacagagcgagactctgtctcaaaaaaaaaaaaaaaaaaaagaataacgtttttccatattctccaaaatgcttcatgttttctgccacagtacataaggaactatgttattaaatgtagaatttaaatgacttctattttatcccaccctggatggaaatttagcaaattcttgttcccaaggcatacaaagaatctaaccaaaggctggatgtggtggctaacacctgtaatcccagccccttgggaggctgagtcaggtggatcacttgaggtcaggagttcaaggccagcctggccaacatggtgaaaccccatcactactaaaaatacaaaaattagccaggcgtggtggcacacacctgtaaccccaggcaatcccaggcacttgggaggctgaggcaggagaatcgcttgagcctggaaggcagaggatgcagtgagccaagatcgtaccactgcactcccgtctgggcgacagagtgagaccctgtctcaagaaaaaaaaaaaaaaaaaaagaagaatctaatcaaaaatcttgccctaaacctaaaggtgaaaaaaacaaaagaaacatccaggattcaggtctgttccaacaactgggccccaaatttcagtacctttagctcagggtctaggatagtacagtggtgatggagatgttctgtgtctgtatctgcactgtccaatatggtagcactagccccatgtggctactgagttctcaaaatgcggctagtgcactgaggaaatatgttttattttaattgaatttaagtagcatatggttagtggtactaactgtacactacaagtctaagttaaaagcatccttggtggcctggcgcggtggctcacgcctgtaatcccagcactttgggaggccgaggcgggtggatcacgaggtcaggagatcaagaccatcctgtgtaacacagttaaacctcgtctctaataacaatacagaaaaattagccaggtgtggtggtgggcacctgtagtcccagctattcaggaggccaggaggctgaggcaggagaatggtgtgaacccaggaggcagagcttgcagtgagccaagatcgcgccactgcaccccagcctgggtgacagagcgagactcagtctcaaaaaaaaaaaaaaaaaaagcatccttgaccctggaagctttctctgacttttgcaagtcagaaccttagggatgggtaacattttccctatacactgaagatattatggcttactacgtgtcagaaaacaagcactacgaactaaaatctgcctggtggaaaggcactgcccctgacttagaagctaatggtaagaaatacatcctctgctattcaatgagaaagatacaaggaaatatcactacactgtttagaaaatatttaaaagcacgactacttacctggatcaattgtgcacacttgtccagtagttctgacaagcgttgggtagtctctatagtaatgatctacataaggccccaattttaagtccctaaaacagtaagggcatgtaaaaaagaaggtattacagcactttctcccaacagaattggaaggattgattagttgaatcttttaatttaaaaacttacatatgagaaagataaccaaatctagagtctctctattgtatttttggactttaaagtgcccagtgtgacaaatggaacccaatctctttttgctaaattttgtggaagtaaaactacagtaaaagcaccgtgatctagttcctcctctgctattagctgtgtgatcttccaaaagtcatgtctataaacctcagtattttcttctagaaaatggggcaataccagctcacttactctgaagttttaaagattaaataagataaaatatgtaaaaaaaaaaaaacctgataaaatgtaaaacatcatacacattacttttttcagagagccatgattatggtttggaaattacttaattacaaaagaattttcatgacagtaatgacatcctaagagatatttaccattgattaaaactgccatgtctcaggattgaatttcaagatctcaaaaaagacaacagaaattagaaaatgtactatgtcttaactcagaggttgacatttcaattcaaattcaacttctttatcaccaaaggtcataaaggtcaaacaacacacaagtatgaccctagaattctgagccatacaccaggtgcttcaaagctcttgaaaggtgttgaaacgtattattagaactatcttattgtggatctactatgagtgcctcaaagacagggacaacctcagactgcaacaaggacagcatagcaaaatgagtccacaactatcaaacactcgcatcccaggaaagacatttaggcaagtttcctcatcactaaaacaggaaacttaccttgtttgagactttacatgtaaactatgattttgtcaactataaagcactatttgaatgtggatattacaaaacagcagatgttattctagaactcccaccgcagtatagccagtcagtcatcctgtcaaaatgaaaatctgagcaggtcatctccattttttcgtgaccttccactaatctcaggacaaagactaaaaatccctgcatggctcacaggcccttacaaaaccagtatcttcaaacaactctgtggtttacagagatgccctagttttctgagaaggtagatttcagaaacttatttacaaggtccctatatgatacaaggttcctatatggaaaagacagtcatctcaggacttcctggcagtttctaacctacaaacaaatttaccttgccaactgaacgagaagttcaacaagtgaacaaattccttctcccattagagtattcaacttaagctcctcatacacaaggtgaagaacgaaaaaaattgcaggtatgtgagtaaagagaagtgtagaagaatccagactgagattctgtgaaaaatcctcatccttcatctgtgaagcttctgaaggactcagacataaagatctgttcaaaagatgagactcaacattctggtggtagtctgaatttagtaaatattcccagtcctgagaagaataaaaagaatattaatttttaaaaataatacctccttataatatcataagaaaattaattcacttaaaacaattcaagtttcattttcacattaagttgatctaagagtatgttaaaaaaaaaaaagacaatgctaagaatgaagtaactataaaatagcaagccagttataaacgttaaggcaagccacctttaaaaaccattaaaaaaaatattttcatgaccttttaggaaagacattgggagaagaattatactatttaggtagagattgagagagaaaatttaagattatctcaggctaggttttataggaaaagtagatggcaagttagtggccactacactgaactgtgttttggtaagaaggaaggtccacctgcattcagctggtgtattcatctttccacatgtataagatgccggggctagtaatataatctaataatcaactgatttttatattcagactgattggactacattttccaaatattcaagtctattttggttctacttgtgatttactgcatttggttcagagaatgtggtttatgctatttccagatcttggaatttactgatgtttttgtaaggcttaatacagtgtgttactctaaattaaaaattcttggactagatacagaaagaactaaccataaaagaaaaaactgggccgggtgcagtggctcatgcctgtaatcccagcactttgggaggccgaggcgggtggatcacaaggtcaggagatcacgaccttcctggctaacacggtggaaccccatcacttctaaaaaaatacaaaaaaattagccgggtgtggtggcgggcgcctgttagtcccagctattggggaggctgaggcaggagaatggcatgaacctgggaggcagagcttgcagtgagctgagatcatgccactgcactccagcctgggcaacagagcgagactccatctcaaaaataaaataaaataaaataaaaaactgataaattggataactaaaataaaaaattctgctcatcaaagacactgttaaagccacattctaagggaaaatatggtcaagaactcatgtctagaacatgtaagaacttcaacagcttacatattttttaaaatctaatttacaagtagataaagatttgaatagaaacttcacaaaaagatacataagcagctaatgagcacatgaaagagtgtttaacatcctccaacctcagcctccaagtagctaggactacaggttatgcgccatcatgcctggctaattttcaaatttttttggtagacaactggtcttactataatatgttgtccaggctggtctcaaactcttgggctgaagcagtcctcctgcccctacccctcaaagtgctgtgattacaggcgtgaattttcatttaaaagaaattaaattaaaagaaattaaaattacagatgtgaattttaatttaaaagaaattaaattaaattaaaagaaattaaaattcacacctgtaatcgcagcactttgagagataggggcaggaggactgcttgagcccaggagtttgagaccagcctgggcaacatattatagtaacaccttgtctctaccaaaaaaatttaaaaattagccaggcgtgatggagcataccggtagtcctagctacttggaggctgaggtaggaggatggcttgagcctaggagttcaagattacagtcaactacgatagcatcactgcagtccagcgtaggcaacagagtgacaccctgtctcttaaaaaaaaaaagaaaagaaatgaaaatgtatgtccacgggcccggcatggtggctcacacctgtaatctcagcactttgggaggccaacatgggcagattattgaggccaggagtttgagaccagactgaccaacatggcaaaatccagtctctactaaaaatacaaaaattagccaggcatggtggcacacacctgtaattctagctactggggaggctgaggcatgagaactgcctgaactcgggagtcagaggttgcagtgagccaagatcgtgccactgcactccagcctggatgacagagcaagactccgtctcaaaaaaaaaaaaagaaaatatatatccacaaagacttgccagtgaattttggcactagcttgctttattcataagactttaaaaaaaaaaaatggaaatagcctagatatctaccagcagaagaaggatagataaacaaaccatggtatattcacactactcagcaataaaaaagcacaaactactggtatctgtaacaatatgaattaatctcaaaagcattatgctgaataaatcttataccaaagattacatactatattattttatttacatcaagttctagaacaggtataactaagatatggtgacagaattcagatcagtgattgctagaagaagagaataaagctgattaaaaacagcaagaggggccgggcccagtggctcatgcctgtaatcccagaactttgggaggccgaggtgggcagatcacgaggtcacgagttcaagaccagcctgaccaacatggtgaaaccccatctctactaaaaatacaaaaattggccaggcgtggtggcgcatgcctataatcccagctattcaggaggttgaggcaggagaatagcttcaacccaggaggtggagagccgacatcgtgccactgcactccagcctgggcgataaggcgagactccgtctcaaaaaaaaaaaaaccacacaaggaaattttatggagttataaaaatattgtgtgtctttataggagtgtaggttacatgagtgtgcatatattaaaactgatcaaactaaacccaagctgtatttcatttttgtaaattacaccacaatttaaaaaaacatatttggaccactgaagaataataccatggaggccaggtgtggtggctcatgcctgtaatcccagcactttgggacaccaaggttaggaaggtcacttgacgtcaggagttcgagaccagcctggccaacatggtgaaaccctgtctccaccaaaactacaaaaattagctgggcatggtggcgggcgcctgtaatcccagctattcaggaggctgaggcaggagaactgcttgaacctgggaggcggagattgcagtgagctcagatcctgccactgcactccatcccgggcaacaagagtgatactccgtctcaaaaaaaaaaaggaatataccatggaacctgatacaattgagaaccttaatttaaaaaacactgcataaaaaaggtaaatgctgtcatttcaggtgatcagttgatactaaaatgtctacaaacccaaactgaaatcatgcagtaatacatgtattaatttttagataatcattaaagaccacagaaaatgtaacagatcctactcttcaaaataattgctattcagtattaaaataaataaagtgaaaggtgttggaaagatagaggaattgataggaataccacagaagtggaagaatagtatgaatatccataaattaatttatattagcaagaaataataatgcttacatcatcagatccagtctcggaaggccttgcttttttgggcgcaatgacaggagaaagtgatccttcaaagtcaaactgaaaagtaaccccaaaagaaaagataaaaatcgtaaatgcattcctgtcaactgatcaacttcaaggattcagaaatcagttctgccaattacgaaaactgagaaaagccatcaaaactcattttttgatctggaaaggcattatttaaatatctttcttccaggttactgtaaagatgaaatgaaatcatattaatatatgcaaacatctagaacagtgcctgggcttctaaggactgattttaatggtagtttccttccctctcctactcctgtaacaacatagattacatcacatctttggtagaaaaagaaactttaggcatatccacaatataccaagtctcaaaggatcaacccaatatcagtcaaatgttagaactaagcaaacatttatttacagtccacctacagtaaactatctaacaattctatggcagagacaagtagctactctggaaaatcttttttctcctctttctcctgaacccacagccagactacatacatacgtctgcctcctttgaagttaggtgtgaccctttgacagagttaattataaatggaagtcactgtcatcacttccaggaccagtccagtcctacccctgctcctccaggctctttgccccttccacctgactggaatgcagtcaaccaatggcaatctttgaaccaaagataaaagatcctccatcaacctgggttcctgaataactgtgtggcctgtttatctgctaagccctgttatgtaagcaagacagacatttttattgtgtttgagccattgtatcttttgaggcctttctattacaatagtgagcctatcttctaactaatacaactacataaaagcagttttctacaagttgctcttcttcaatttcccctggcataatctttgctgccccagctacttcacatgggcattgaccatcaactaataaactgtaactctataaatggcaatggctattttcctatgctgaaaaacttacatatttatcaactcactcacctaaacagagttgatttctatataaaaactaaacataggtagcaataaagtgatatttaaaactgaatgttattgagagagaagatctgcttgtgaagcgttcaaataaaaaacagcccaactcatatatattataaaaaacctggtagtaacagtgaaatcaaagcaacaaatataacagtaactatctaacctaaaacttcaaccaaaatgtaacacacacaaactcccacagtcaaaaagaatgtccctgctataattatcagattcataaggcctggagttatgagaaagtagaaactgcctgataaggatggctctttgtgccatacatggatctgtttaatcttcactctttcaatgtgtctcaggttagccaaccctgttatatgctcctatggacccttacccttcatctatcataacacatttatcaaatattatttatttgtttcccccaagacagtcaattccagaggaacaatctgttttgtctggggtatatgtgagaaacctggcatcatgcctggcccacagcagggattcaatatttatctaaggaaaaaaacagcagcccggaagccacaaaaagttaaccccaaatgcaactgttcctacaatgtacagtccagtgcactcatgtaacacatcagcaaattaaagaaagcacaaagaaatgccaaaaattgtgtaacgagtcattggcagaaattctgtactccaccacattacatatgtgaaaacaaaaagaataaatctgaacaaagcaaaatgaaaaccatttgccaatgaggaccattttatcctaagctttgactatgaggacaaaagataacaagggtttaaccatgcagtcctataaataaatagcaaagcaacttggcctcaagaattgatttccttattccttcctttataattatcatgcaataagtaagtcaaaaagccatgtccttctctgcaaaggaaaaaatgggtaggtgctcagtcctccccaaaacatggaaacgcgaaggggcataggttctctgccagagactaggacacaacaatctgtactcatcaacaagttacaaggacaatgatacacaaaactacagaaagctgacgcgttttttcataatgtagaaatccagtttctatgaggcttaatcttttcacatgtaataaagaacagaaaaattggggataatgtcactcggatacaattgtttaaaataagaaaagaaggccaggagccgtggttcacacctgtaatcctagcactttgggaggccaaggtgggaggatcacttgagctcaggagtttaaaaccatcatagccgacacggcaaaaccccgtctctactaaaaataaagaaattagccaggcgtggaggtacatgcctgtaatcccagctactcaggaggctgaggcacaagaatcgcttcaacttaggaggcagaggttgtagtgagccaggatagcgccactgcattccagcctagacgacagagcgaaaccccgtcttaaaaaaggaaagaaaagaaaattgtccctattttcccataagatttctctcaaggaaattgcagagagcaattccttcatgtgctgaaatagacacaaactcttaaaaacagtatctcactcagatggaaaatggcattcactcaacaaatgttcactgagtatccttctatgccaggcaataccacaggtcctggagagagagagtagtaaacaaaactaagcaaaaatctttgccttcctagaatttacattccagttgggggaggaaggacacaaaacaaaataagtaaaacatatagtatattatatttaattaagtgagaagaaaaaaaaacaggtaaatggcactaaaggtatggaggcaggtgtaattctatagagacaggacaggcagcactgaggtgacatctgaataaagacctaagcacgtcttgtcggagggaaagcattctccatagaggtaatggcaagtgcaaacactcagaggcagaaacatgctggcagtgctcagggaacagagctgaggccaatgtggctgggatgatgtgtgcaaagcattaagaaataagagcaggaaggtgagcaagggctaggtcacatggcatcttataagcctatggcctttactctgagtgacatgggaagtcactgggggattctacgcagaggcgtgacgaacgcaacctgacgttatcaaacaggattactgtggccactggactgagaagagactggaacatagacaaaggacatgaaatacgaatcaaaaaataagaactataaataactgatgaaattttgaaaaaaacattcccatttacttatagagaaataagataaaatttctcaggaagctggcaaaggttcaccacaccacaaataaacactgtggtgaaatgggcgcttttaaatgatgctagtaagaatgtcacctgggaacccctttccaaacattacttgacctcacagtttctcttttaagattcaatgcttgggaagtaactagagatgtggttaaagagtcgtgaaaaaggatgtttataaattacaataacgaaaacaacagattcacaaggtacaattattagctattggttaactatgataaaactacactatgaagaaatgatggagatattttagaaaaaatttttaatgatacgggaaattttcattggtatttttatatagaaggtaacatcaaaaatatttagagtggttatctctaagtagtataattattttcttaattcctccattttccacattttcctttcataattaagacaaaaaacaaattttaaaaatggatttgctggccaggcgcagtggctcacgcctgtaattccagcactttgggaggctgagacgggcagatcatgaggtcaggagatcaagaccatcctggctaacacggtgaaaccccgtctctactaaaaatacaaaaaatcagccaggcgtggtggcgggcgcctgtagtcctggctactcgggaggctgaggcaggaaaatggcgtgaacccaggaggcagagcctgtagtgagctgagattgcgccattgcactccagcctgggcgacagagcgacattctgtctcaaaaaaaaaaaaaaaaaaatggatttgctgtgcaaggctaaaacatatagaatggtacagctgagctacctggaaaaggggtaattataatctagagtgattttttttcagagtgacccaggcaaagttgtcctgggagtgatctccaaagctagaaggagatcaccaatactgaagacaccactctgctgattttgtaaataatctaataagggcctgtaaggatgttactgcaggaagagggtgagaggtaaggctttataccattaacagagtagatactcaggctaaagtactttaaatctccctcaaatcaaaccttcctcttcacatcccaagcaatatgtgtgtaaaaagacaatcttgtcttcagaaaacaatgttaaacaaggagtcagaagatgcagtctagtcatagttgttaaaaaaccacagatctgtgatttctttgtgatccagtttcttcatcaataaaaccaagactatcactaatcctagcataacttgcagtcattttacaaaggtgaaatgagaaatagtcatatatgctttaacattctaaagctcagtaattataatcactagtaaaatgttaatattaaatattaagtgagattttatttacaatatatagatacaataaaccttaatattattctattattttgaatatggtacgcctattatgtagtctcaatgttatattaccaattatgcaaccattacattaacagaataactcataaagaaaacaatagtatttacttacatttctagtccatgctaagcggtctgtgttataacccatcatgttcatgagacaagtcacaaataaattccactctgagtgataactgggtcctcctggagcactgtggacattgtaccacttgacaagcatctgaactgctatttcttttggcaggataaacttaattgcttgcaaacacgtttgtactattaaaagcaaagattaattttagtattcttactctgcatgcatttcttttcccctttcaatcaccaagttttttaacttctactatgtaaaggccaattattatgaaaagaaaactgtcattaaagagccaatgagatgcaaacattacctaaccaatcatctgaaactaaaaccaactactgaattcaacaaggcttgaaaggggtctgaagacagcttttttttttttttttttttttgagagggtgtctcgctctgttgcccaggctggagtgctgtggcacggtcttggcacactgcaacttctgcctcctgagttcaagcgattctcctacctcagccaccaagtagctgggattacaggcgtctgccactgccccaggctaatttttgtatttttagtagagaccatgtttcaccatgttggccaggctagtctcaaactcctgacctcatgatccacccgccttggcctcccaaagcactgggattacaggtgtgagccactgtgcccggccaaggacagctttttgatcattaattttgcatcagaaataaagtaatcaaatagcccagtttgccagagacagtcctgatttacatccattgcccagcaattactaactgctcgccttcactcttaaagatgttctagctcgggtgacaaattaaaagtcactatgggccaggcatggtgactcacgcctgtaatctaagcactttgcgaggtcaaggcgggtggatcacctgaggtcaggagttcgaaaccagcctgaccaacatggtgaaaccccatttctactaaaaatacaaaaattagttgggcattgtggcaggcacctgtaatcccagctactcaggaggctgaggcaggagaatcgcctgaacccgggaggcagaggttgcagtgagccaagatcacgccattgcatttcagcctggatgactagagcgaaactctgtctcaaaaaaaaaaaaaaaagtcactatgaaaaacatacaacttctatgtttatacatttatataaaatactgcctacatacttcagtaaatatataatattcaatatatgcatccacgaatagcaatgcttagctagcattacatgatgttctaaatgagttaacatgcctattaaccaaagctttataactttatttctgaggtcgttcagtttctaaaatgtttcacaggctctctgtcttaaaagggttaagagttaataccacataatttacaccattctttttttggtaaggggaaacagggtcttcctctgtccccaggctggagtgcagtggtgcaattatagctcactgtcacctccaactcctggactcaagtggtccaccagctcaagcttcccaagtagcaaggactacagatgcatgccagcatgcctggctaattttatttttctttttgtagagacagagtctcactatgttgtccaagctggtctcaaattcctggcctcaagcaaccccctcacctcagccttccaaagggaggggattacaagcatgagcccaccacacctggccttataccattctcaatggctccacatcaattatagcactacactgtcatacaatgatcccctcagagtggccagggctaccactgtgaagagacccaaatctgcttttagtagtaaataatcccaaactgcaatgtttgtgtactcacatatcctctcttccaggattcttttttccctttccactgtcatgccactgggcccaccctcatcaacatatcctctatcccatcagtttgcaatgtgcaaactcacacagcacaggttggaagcaaataatattaaaataccaaataaccaagtatgtcatagtggaatccaaaataagtgtaaacccaatgctgcatgagtgtgtgagaaccctctgcaggtaaagtacataaacttatgtgcataaactatggggcttctgtttggctataaaggggtaagattttttgttttcatttatttaatttattccattattatttgtttttatatattttgcttaggcttataatagttcgaggtacctggccttgtgattacgaaataccttttagagccgggcgcggtggctcacgcctgtaatcccagcactttgggaggccgaggcaggtgaatcacgaggtcaggagatcgagactatcctggctaacacagtgaaaccccgtctctactaaaaatacaaaaaaattagccgggcgtggtggcgggcacctgtagtcccagctactcgggaggctgaggcaggagaatggcatgaacccgggaggcggagcttgcagtgagccgagtttgcgccactgcactccagaacctgggcgacagagcgagactccgtctcaaaaaaaaaaaaaaaaaaaataccttttagaaggcaaggaatctctatatcaacttggaataccatttaccagcagtgaaaattcctaaaatgaaaaagtcattcttgtctacaatctgccaatgtcctgctttggcagttagatttgaaaccaagatatgtcatgaacttccttatatcatacaggcattcttttcttaacctacgtttgttggcaaatcccttcaattctaacattttgtttactatgctatgttcagaaatattctcctcaagcatttttgaaattgcatctcaggaataattcaagcagaatccaatatttattaagataattctgattgtattttgacaataatattaagttttattcaattaaggcaattaggttactttcacaatttatctgaaaattgagatatttattttaaaattaaaaacatcattaatacattacagaaaaaaaaacattaaatatgccaagaattatcttagttgcttaagcttccagtttcccagatgttcttgcaagaggcatgtccatatatatacatatacatatatatatatatatatatatatattttttttttttttttttttttttttttgagacagagtctcactctatcacctaggctggagtgcagtggcacgatctccactcactgcaacctccgcattctgggttcaagcgattctcctgcttcagactcccaagtagctgagattacagaagtgcgccaccacaccccgctgatttttgtatttttagtagagaaagggtttcaccatgttggccaggctagtctcaaactaccgacctcaagcgatccacccgcctcagtctcacaaagtgttgggattacaggtgtgagccaccatgcccagcaggcatgtccatatattattatactgcacaatattccccaacagaagaacctcagggaacagaactagcacatccttcacctgtactccagccttagagcgcacgtagagtggacatcacaaagcactccctagctctttaaagctcctctacaaagctaagaacttgatccagtggcttcaaaaatggcaaaataatgtttaaaaccccaattattaatgtaaatcacaattacttcatgtcttataaatgaaacttctcaatcgtacctaactcagaggtggcaatttcaggaatagtgatcctaaccatggagccattactcagttcctagatggaaacaaatgagaaagtagataaaatctgtgcattctaagtctttgaatgtcttaaaaatagctggtacaagactttgcccatcaaagcaataaaataaatgaaaaacaattttcaaacagaaatgaacacttccgaatttcagaaactttaaatgtaattatttgcaaaatgttttccaaaatgcttgttttaataaaaagtgtctaatctttatacagtgagtcaccatcatcaaaaggacatttacttttaatgagaagacaaaaaatcacatcaatatacaattcaactgactcaacaagcttttgttttcactaagtttttaataatacagaaactgtagaaaacaagcagaattactgtatagtaaaaagtaaaatcgtgccaaaaaatgacacaatagatttttttaaatcatgagaaatgtttgttgtcatttttcagacaaaattctgtattctgtcaaatttgaaatgccagcccacttcttggaaagctaccaaatgtttatacttaccagggtgactctgttatggacaggatctctgatagaatgaatgtaagttccaagctgttggaaagtacaatcctcattatagagagaatcatgaagttttgaagaatccctcagttctggaactggggacaacagaacaacctgtaaaaagttgtaaatacgatacaaatgaattgttttctgagaaattaaggacaaggaaatttaactgtttcttttttgcatatggtctaacaaacaataatatgtaatgattcaaaaacattctgctccaagccaagcatggtggtgcacacctgtatagtcccagctactcagaagactgagacaggagaatcacttaagcctaggaatttgaggctgtagtgagcctgtgaatagtcactgccctccagcctggatgacacggcaagacccaggctctttaaaacattttgttccagatacaatgaagtaccagcaaaccaaggtcctcacagaaaacaactagaaaaggtaggtaaaaggaaaacatctgattggtggctatggaaaagctgtggaagcaacctggacttgagggaccaagatctaggagagaaggcaactgcagggaaaggggccaacgttcttggagagccttgctttttctgctctggccatctgcaaattttggtggtaagaggaacatatggaaaggctgacaatatgcaaggaaagtcatagctaagagggagagaagccagcagcactgttagcaaccttacagggctaaagactaaactgtgagccggggcacgcggtggctcatgcctataatcccagcaccttgggaggctgaggcgggtggatcacttgaggtcaagagttcaagaccagcctggccaacatggtgaaaccccatctctactaaaaatacaaaaattagccaggtgtggtggcgggtgcctgtagtcccagctatttgggaggctgaggcagaagaatcgcttgaacccaggaggtggaggttgcagtacggtgagattgccccactgtactccagcctagatgacagggcaagactccatctcaaaaaaaaaaaaaagactaaactgtgatttgaggcagctgaggaactaagagcccaggaagaaaggacagtaatgaaaaagccaacaaatgagaccagtatttaatggtatttcccctataggcaattatttattcaaaaatacaggaacagtatttatttgcttaactgcagatatgcaaacaaaaaatttaaacgatcttagttactatctacatgcagatgcttccaatcttaaactctagtcatgaccactgatcctttttgattcctttaattcaatttatatatctctaagtgaatatcttgtcaacactgacaatcaagactaagatgtatttactctattccagattctactctaaaagtcaccaggaaaaattcagctccgctggtcctggctctaagtctactagcaaaatcttccagagaagtggaaaagccatcaatcagccaatgtgttaagactatcatttccatgactttacacctatcaaaaaggcactattaccaggcttatagaattctaaaaaagttggaaaccattttccattataaaagaaattcttccaaatcacacagaacactctgacacttctccagttccccctttgaatgttctgcaaatgtgctggtttgaaggaaaaaaaattcaatgtggcacatgtttaaaaatataatgaagacacagacattatcaaatacaactgatagcactaaccttccctttgaaccgtccctaaacatccacactcacatgtcctttaaatacaaaccacttttctccaggcttcctaacttggtaaatccaggtaccttcccaggtcattcagagaattcggagcctcgttccacatcacctttccccagcccagcagcacaaaaccaatcagctgacaaactcatttccacctctcaaggcctctcatattaatccctcctttccacacatatactgccctagctcagaccctcttcatacttcttaaactgacacagacaacctcacttggaggctaaccggtctccttatctttaatcccaaaatacacctatttacaacacagatccaaaacctcataactcctttctcaaaatcctgtaatgccctgtcaattgcattcagaataaaaccacctttttatcctttctgcctttaagagcacattagtaagagtgtaaatcccagttctaccacttattaggtttatttcatttgtaacttctatctcatttgtaaaaaaaagaatcatagtactatcttctcaataaagctattctaaggaaataattaatactaataaagcactgagaacaatgcctagcacatagaaaatgctcaaaaaaggttattattgttatccaaaccctatcctgcctcaccctacagactacttgtacttttataagtatttattctacagatttattgagtccttatgactaggagatgaagatacaaatatccactaaaaaatgttccacattatctggccttcctgcctgtgcctgtgtggtttctccttgccctgaatgctcctttctacctacagatatcctactcaaccccaaggtccaaacgaagactgacatgtctctcagtgaggctttgattttgccatgtcctcccattggatgttatcttcccatcggatgttatcttcccatcagtcaatcaacgatggtactctcttttccacattactgagtcatgagtctttcttaaattctaatttcttatgcagacagtacatcaactccacacaattgtgagatccctagatggaaaagaatgtatcatttccatctctccagcaccttcaaaaagtatcacatacatcacaagggaggtcagtgtatgttaactgaatcacttctgtttgaaaacatttattctgcaagtagaaactaaaattaagttaaccatggaaagaactaatgtttaaccaaacttctttaaaaaatgttaactttttggcaacacctagtccttttcttacctcgtccaatgatccaaggagtttactaagaggctttggagtactaacgccatctagtggagtactgggccgaggcattgtgttggacatcgtcagagagggagctggcagtccaggaataaaaacctttcccacctttaagcaataaaaacatgtggaaaaaaaaatattgcctttaatgcatcatatccttaaataaaatgttaaggaatataaacatatatttcttttgatatttctaagtttatactcaccaaacacagcaaagaaacaattcaaatgtcaataatctatccaattccactatccaactgcaaatatgttggtataattttttttttttttgagataagatctcactcttttcccgtgggtggagtacagtggcatgatctcagctcactgcagcctcaacctaccaggctcaagtgatcctcccacttcagcctcctgagtagctggaactataggcacatgccactatgcctggttaattttgtattttttggtagagacagggtttcaccatgttatccaggctggtcttgaacttctgggctgaagccatctgcccacctagacctctcacaccttggtataatttctcttggttggattccttctcttcattactgaagacttttttttgcaggcaaggagaggaatgttaatatagtcaacacattatataaaaatctgcacactatgtactcttctacctttttggtcataaagacagtaagaacagcggccgggcgcggtggctcacgcctgtaatcctaacactttgggaggccgaggcgggcggatcacaaggtcaggagttcaagagcatcctgcctaacacagtgaaaccccatctctactaaaaattaaaaaaaaaaaattagccgggcgtggtggcgggcgcctgtagtcccagctactctgaggctgaggcaggagaatggtgtgaacccggcaggcagaacttgcagtgagccgagatcgcgccactgcactccagcccaggcaacaagaacgaaactctgtctcaaaaaaaaaaaagaatgagttgacaatccgtgctaaccactccttattttggctatctgtagggtacttagcaaaaacagaaattcacatctgtacaagctgaaaacttgataagactaaaaaggagatgctcagaactaaaatgagatattaacaacgtacgtattcatgttaacacactactcaaaagctaacaaaataacagaagttgccccaataaaatccttaggcttaaaaaacaaaaataacagtgagaactaattatgcataattttttaaaagctatctcaaacccctaatttacgaaaagatggaataagcacataccatgctattccctcattaatcaccaaaaagaaaaaaaaactgaataaaatttataatgcaactaacagaagattctgaaaaagtgaagaaaagaagacaaactggctagtaacctgagacccaggaatgacctaatgatgaattccctaggtttctggtttgattccttacgtaaccaggccttaggctttcaaagtgcctataacacagacatgccaacgttcacagacaaaacacgccctaagaaaatcttactctttccagccaaagtgttgggaaaagaatgactgaccaggacagaaacttttcactatatctgccctactctttgcaaacaccaagaaaaaagtcatggccatcccttcctcctcatcaggaggcacagtgaaaattttgaatgtccctcgtctatttgaggaagtccccttctatttctagatgctgaggattttttttaatcatggatattttattttatcaaatgatttctctgcatctatttagatccttggtcagcaaaccatgttccatgaccaaatctggctcgtatcctgtttttgtacagtctgtgagctaagaataggttttacgtacttaaatggttaaggaaaaaaaaaacagaagacaaatatgtaacagagactgcatgtggcccatagaggctaagatacttgtctgaactcctacataaaaagtttgccaggcttgatgtggtggctcatgtctgtaatatcccagcactttgggaggctgaggtgggaggatcgcttgagtcaggaggtcatgggtgcagtgagctgtgatcccaccactgcactccagcctgagtaacagagagagatactgtatcaaaaaaaaagaagagaaaagaaattgccaaggatggagaggacatgaacaacattatcaaccaaatggaatgaactgacatttataaaatactcaagggtgccttcttggtgatttggccctttaaagtctctctttgttcctggtcatttttttttcccactttatagagactccagctatcttctgattactgtttgcataatatatcttctttccatcctttaacttacccatgtcattatatttgaagaacacttcttataaccaacatatatagttgggctgtattttctaatctcttccgctagtctctgttatttgtgttagaccattgtatttaattagtggcctagtgggatttaaatctgccatttaatatttgttttctgtatgttcccactttctttgctcatccagaagaagcaactcttcaagtttgatcataagattttggcaattctgttcaagtttggcaattctgttcaggtttaatcataagatcttggcaatttagtcacatcttcaggctctacttctaattctaattctcctgctatttccaccacatctgcagtgacttcctccactgaagttttgagcccctcaaagtcacccatgagggttggaatcaacttcttccaaattcctgtttatgttgatattttgtcctcctcccatggatcatgaatattcttaatggcatctagaaaggtgaatcctttccagaaggtttctttttttttttgagatggagtctccctctgtcgcccaggctggagtgcagtggcgtaatctcggctcactgcaagctccgcctcctgggttcacgccagtctcctgcctcagcctcccgagtagctggaactacaggcacccgccaccacgcccggctaattttttgtacttttagtagacacagggtttcaccgtgttagccaggatggtctcgatctcctgacctcatgatccacctgcctcggcctcccaaagtgctaggattacaggtgtgagctgccacgcccagcccagaaggttttcagtggactttgccagatctctcagaggaatcactatctatggcagctccagttaagtaatgtatttcatagtaagactttaaagtcaaaattactccttcacaggctgcagaacagatgtgtcagcaggcatgaaaacaacattcatctcctgtacatctccctcagagctcttagatgaccaggtgcactgtcaatgagcggtaatattttgaaaggaatcttttttctgagcaatacgtctcaacagtgggcttaacacattcagtaaaccatgctataaacaggtgtgctggcatccagtctttgttactccatttatagagcccaggcagagcagacttggcataattcttaagggccctaagatttttggaatggtaaatgagcacgggcttcaactttaagtcaccagctgcattagcccctaacaagagagtcagactgtcctttgaagccaggcactgacttctcctctcaggttatgaaagtcctagatggcatcttcttccaacagaaagctgtttcatccacactgaaaatctgtttagtgtagccacctgcatcaattatcttagcagcttctacatcagcacatgctgcttcaccttgcacttctgtgttatggggagggcttttttccttaaacctcaagaatcaacctctgttagcttacaacttttcgtctgcagcttcttcacctttcttggccgtcacagaattgaagagagttaaggccttgctgtggattcgacttcagcataagggaatgttatggctggtttgatcttctgtccagacactaaaactttcttcatatcagcgataaggctgtttcgctttatcagttgccatgttcactgaaatagcacttttaatttccttcgagagcttttcctctgcatgcacaagttggctcttgtgcacaggtggtctggctctcaacctatctcagctttcaacacgccttcctcactaagcttaatcatttctagtttttgatgtaaagtgagaaacctgtgattcttcccttcatttgaaaacttagaggccattagagggttactaattggtctaatttcaatattgttttgtctcaggatatagtgaggcaggaggagacagagagacaggaaaggggtcaaatgatcagacagaccacacaaaacatttatcaattaagttcctcatcttatatgggtacagttcgtggtgccccaaaagaattccaatagtaacatcaaagaccactgatcacaggtcaccataacagataaactaataacaaaaaggtttgaaatattgcaagaattatcaatatttgaaacagtgacacaaaatgagcacatgctgctggaaaaatggcaccaacagacttgctcaacacgaagttgccacaaaccttcaatctgtaaaaaaaaatgcagtatctgtgaagtacaataaagcaaagcacaaaatgaggtacgatggaatactattaaatatatacatcacactgaatgagtaaacaacacacgcatcaacacagacaaatctaaaacaaatataatgttgagcaaaataagtatatcagaggcgagtacatggtatctttttttatataaaaattcaaaaacaaggaaaactaaataatgcattctttagtgatacatacataactgtaaaaactagtaatacaaacaactgatttatcacaaaatcaggattctatctcgagggcaggggaagataggatgcaatcacaaaagaatgtaataaaaataaggatactggcaatattctatttcttaaccagagtactgggtagatgaatattcacttcattattattattcaaattgtatgtatttaaatttcataatttaaatttgtaaaatgtatattctctacgtacatttcacaaatgttaaaaaatacagctagcggctgggcgcggtggctcacgcctgtaatcccagcacgttaggaggccgaggtgggtggatcacgaggtcaggagatcgagaccaccctggctaacacggtgaaaccccgtctctactaaaaatacaaaaaattagccaggcgtggtggcaggcgcctatagtcccagctactcgggaggctgaggcaggagaatagtgtgaacccgggaggcggagcttgcagtaagccgagatcgtgccattgcactccaccctgggcaacagagcgagactccgtctcaaaaaaatacagctaacatataccacatttaatatagtgaaactttaccaaaactttagtacttaccaaaggtacccatgcttcaatttcaaaactttaactttaaaaaaaaaaaaaaatctacctatactcattgaaggtttcccatctgtgacaggtttagagtaccaatgcatttaacagcagtgagccatagccctccaaattaggacccacctaaataggaagcttcactgagaattattaacaaaattcttctgccaaattgtgcagacaggaacataacaaatttaaaatatcaatctaaagtaacattacaaatattcatgcaggcagcctgaagtcctactaaaggcatgaagtgctacttattgcttacccgaaccactcctgtgtatagcaccaggtttccactgccttccaagaccagcatggtgtctattttctaaaaaaacaaaaaagacaaaaaatttatttcccaatctgagcaaattaacagattttttgactgaaaaatctgttgaagcgtaattgtcaacttctcaaatgtgcctacattacctccactggtgctgcatcctttgctggtatgttggtcactgaaccaaagatgagctgggttttatcattactctcttgaaactttacacagctaaataataaaataaaaaagaaacttgatacatgcaacaacctgtatgggtattaaaagtattatactgaacagaaaaagacaatctcagaagtttacatactgtatgagcccatttatataacattcacaaatgccaaattatcaagatggagaattagtggttaccaggatcagtgggtaatggtgtatgtgactataaggagttaacgtaagacagataaagatgttttgtatcttgattgtggtggtatttacacacatctacatatgtgaaaaaactgcatagaaccatacatacacataaatgagtacatgtcaaattgatgaaatttgaaataaagtgtgtacatcatctatctcctggttatgataatgtattatagttatataagaggttacctgtgagggaaaaagaatgcaaggtacacaggacttgtttactcttttgtaacttcctttaatctatcgtatttcaaaatatgaaggtaaataaatgggcaaaagatctgaatagctattttacctaagaagataaatgaatggctaataacttcatgagatgatcaacatcagaatgcattagagaaaagcaaattaaagccacttcacaaccactagaaaatagctacaatcaaagagtgtgatgatatccaatcctgtcaaggataaagagacattaaccttcatattttgctggtgggaatataaaatgatacaggctatttggaaaacagtttggtgatttcttaaaaagttaaacatgaatttaccattcaacccaatgacccaatcctaggcatttactcaagaaaaataaaatcacatatgtccacatttttgctcaagacctttgttcaaatgttcatatggtcataattctcagtagtcaagaggtggaaataaaccaaaagtccgtcagctgatgaacagataagcaaaacatggtggtagatctatacaatggactattacatagcaataggtatgaaataatgatacatgttacaaaatggtggatcctaaaaacatcacgctaagtgaaagctaaacacaaaaaggtacactgtgtgtacatacattatatatatataaatgtccagaaaaattaatctataaaggcagaagcctagcatggttgcctgaggctggaaatgggaacaagactgactacaaacaagcacaaggaaatctttttatggtgatataaatcttgtaaaactgggtcatggtgatggttgtataacactgtaatttactaaaaatcatttaattatacagtaaaaacatgttaattttatgacatgtaaattatttctaaataaaactacttaagccaaaaaaaaaaggaaagaaaagaaaaagaaaaagcagtgctaagttatttatacagaaacaatgggaaagacatacacctaccgtaactggagctgggactctactaaaaagcacaggaacttttgcccacataggtcagatgtaataaacacttttgaggcttgtgaatttttctctctataatagatacattaataaagtaactgtcagcactggtccaagaatctaccacagtaactattaaaagtctttgaggccgggcgcggtggctcacacctgtaatcccaacactttgggaggccgaggcgggcagatcacgaggtcaggagatccagactatcctggctaacacggtgaaatcccgtctctactaaaaatacaaaataaattagccaggcatgatggcaggcgcctgtggtcgcagctactctggaggctgaggcgggagaatggcatgaacccaggaggcggggcttgcagtaagccaagatcacgccactgcactccagcctgggcgacagagccagactccgtctcaaaaagaaaaaaaaaaaaaaaaaaagtctttgaaaatattctgcaagaaatctaaaaactacttaggtcaagcaataatctcaaagacacaaacatttctaagaattaaacttcatgatctctaagatcctttcagttctttgattatgagctcgttacacagctttgttggggaaagctacaataaatttaacaattactgatgaacttttaaattacatactatgtaagctccctacttgtaaagtaatgcaaactaagccacctacttgtaaagtaatgcatgcaaacttgaattcctatcccgcaaagggccagatctttcataatgctatttctcctatctaccccctctccttctcagattaggcctcattcacatctctttttgaaatcgtatctctaattcccaaacccttccttctaaagtgctacagaaggccgggtgtggtggctcacgcctgtaatcccagcactttgggaggccgaggtgggcagatcacctgaggtcaggagttcaagaccagcctgaccaacatggagaaaccccgtctctactaaaaatacaaaattagccagtaatcctgtaatcccagctactcgggaggctgaggcaggataatcgattgaacctgggaggcagaggttgcggtgagccaagatcacgccattgcactccagcccgggcaacaagagcgaaactctatctcaataaataaataaataaataaataaatagtgctacagaagacccataaatctaaaaaataagaatctataatatattcaacttacaaataagttatttaaagaaaaatgatttataattgtaggatacttttgatatatgagaaacaaaccagacagactacttcaacattgtatccacatctttactttcttcagactacctattccccatttcattctctctaagattatgcatttgccttccatttcagataaaacgaggctctaaggcttgagctcaacctcctgccttacatatctgatcaaccttcacttctttatcccaatctcaccacttatgcacctttctggttacttgttccatcaatcatttcctctgttctgtattttcaatactttcccttgagtatagtccgtatagcctactacttcacattaaaagtcttaaaatacaaaatggactcaacattagagtatataaaagaccttctcaattcgactggatataaaacttgtattgtggttaggttagaaaatactgggggccaggcacagtggctcacacctgtaatcccattactttgggaggcagaggcaagcaggttgcttgagcccaggagtttgagaccagcctgggcatcacggcaaaatcctttctctgcaaaaattacaaaaaattagtcaggcgtggcggtgtgtgcttatagtcccagctatctgggaggctgaggttggggaatcacctgagcccagaaggccaaggctgcagtgagctgtgattgagtcactcactgtactccaacctgggtgacagagtgagaccctgtttcaaaaaaaaagaaaaagaaaatactggggcaagatgtcatgaaaactaattttattatagttcagcaaaaacaaaactctccttgaccaagactccctctaattttgtatcttcattcctattcaaaggcaaactccttaaagagtctgtatgcctatgttcatttcctcagtccccatttactttttctaccccactttcccccgccaccctcccagcttaaaatgctctggccaaggtcaccaaggaacccactgccacccaggtacctcctctctgggttcaactctcagggccacacttcaccagtacctggcaatactggcatctctgtattcttgaaatgttcttttttgtattctgtatttcctgctgcttctcccatctgacctcttttgctttgtctctctgtgccagctttgtctctttccattccccaaatcttaagtttccaggacttcagttcctagccctcttctcattctacaccactggattttaactatttggaggccacaaatccctttgagaatctaaggaatgttaaaaccctctccttgggaaaaggcctatatactacatgtacacacaattattgaatacaataattcttcaattctaatctaattctcttacctcaatcaccacctataagctgacaattccacatttattgttctgctctttcccaaacttccgacacacttataaagtgccttcttaccgctgtcatcaaacataccagaggcctaaagggcaatcagtaatctctcaagcctcctttttttctttttcagacagtctcactctgttgcccaagctggagtgcagtagtgtgctcttggctcactgcaacctccaactcccaggttcaaatgactctctcacctcagcctccagagtagctgggactacagatgcacgccatcatgcctggctaatttttgtatttgtagtagacatggggtttcaccattttgggcaggttggtcttgaactcctgagctcaagtgatccatctgcctcagcctcccaaagtgagtgattacaggtgtgagccactgcgcctaggaagcctcctcttcattagccttttccctcccctctgcaaaaaccagagtggaagtacttgtaattccctaaatacaccacgcactcaccagaacttttgttctgatcccagctgccgtctgtggtctttctcaacttccctgcctagcgaatacctattcgtctttcaaagccctaccagcaaaagtagtccctcctgtgtcaccatccttcagctatctgcctcttttgaggacagggacagtgacttattagactgttaactagcacacacattggcatataaattaacacgtgaattattaaagagaatataaaagaagaaaggtcacccagaacagagatctaagctatgtttcccaaaaagtaaagctggcactcaactaacatgaacataaaacttaggaaacgtgctaaaaccccacatttcctcacggatggaaattaactgtttctccccagaacaaaaaacacccgaaaaatgagagattattactataaaggaagaaatatcagatgacaaaataatatttttatgatgactttttttttttgagatagtctcactctgtcacccaggctggagtgcagtggcacgatctcagctcactgcaagctcagcctcctgggttcaagcaattctgcctcagccacctgagtagctgggattacaagtatgcaccaccacacccagttaatttttgtatttttagtagagacagggtttcacaatgttggccaggctggtctcgaactcctaggctcaagtgatctaccagcttcagcctcccaaagtgctgggattacaggcatgaaccaccacgtccagcctatgatcactttaatatcattaatatcctctactgaaactgaggtggccttaatacatatctctatatatttttacatatattaataactgatcacattaaaaggaaactttaaacaaaatgccatatatttcccaagactttcagcaacatttttctttgaatataataatatatataacaaaccttatattagtaatcgtttctgtccacaaatggtcaatacacagttcaggaacaattggctccgtttctggtgcaagaaaggagccattagaattactatttggagaatgagaaatactatgtctctttggagactgattatggcttgaaatgttgaacctttgcacccctgaaaaagagtgcactcctaacgcaggagaatgagcacgactgcaaaataaacagaggagagagtacatcacagttagcaaggcaggcttatatgacacacactccaatgacacttccaaaaattccacagacagaagagcattcatggcataatccaggtcagaaattaaaatttttcaaaaaggagtagctatttaaatggttcatgtcaatgtgctttactatattctaaagatttagaattattattagaagaactcatcttttacaactaaaacttagatcatcttctttttcggaaaatgaatgattattcaaaaagctctaaactatgtccctgtatagtcagacatatatatttatcaacaaaacaatgtccctgtagcaccagatatacatatctggtcatttaaatatatatctatatagagaaatagatacatttacatatcaaataacaagtaaaaaaaaaagaaaaactaacataaattaaggcaaaaataaaatagtgccacagtattttgggaattaatattcatcaaactgttgcccacatagtggtagaaatgaggcaactaaccttaggtcaagcataggcagcttcaaaatatgactcaggaaagaatgtgacatggtaaacttagaaatcttagtaaaagtggctcagggctgagcacggtggctcacgcctgtaatccccgcactttgggaggccaaggcaggcagatcacaaggtcaggagatcgagaccatcctggctaacacggtgaaaccccatctctactaaaaatacaaaaaaaaaaaaaactcagccaggcatggtggcaggcgcctgtagtcccagctggaggctgaggcaggagaatggcatgaacccgggaggcagagtttgcagtgagtcaagattgcgccactgcacaccagcctgggtgacacagcaagactccgtctcaaaaaaaaaaaaaaaaaaaaaggctcaattgggataatggctatttcccctaaaaaacatctcccctaaatatatttcccctaaaaacagctgtcaacagaaattctaaatccttcaaaacaaaacagaaagcttagaaagaaaaaccaggaaacccttataccttagagctgccatgttggaaatagaaggtgagcgagaatgtagactgggtgatgaggttgagcgactctggctgtgaatggaggagtaattctggaaaggtgaagtcacaggggaatctcctttggagaggcttctgagatgtgctgtgagggagctgctagtggccacattctgtggggttcccccctgttcagagaactttaaaacaacattctcttccttaagtcaaaataaagagaaagaggaaaaaaaaaaaaacaataattagaataaagtagcaatttccttgtaagaatgcaagttgaagtcagttactaaagacacagtatttcttctttcctaagaagctcaatctatttctcaaatgaggccaggtgccgtggcttacatctataatcccagcactttgggagggtgaggagagaggatagcttgagccaaggaattcaagaccagcctgggcaacatagcaagatcccatctctacaaaaaattaaaaattagctgggagtggtggtacacatttgtagtcctagctattcggaaggctgaggcaggaggatcacttgagcccaggagttcaaggctgcagtgaactgtaattgtgccattatacttcagcctgggtgacagagtgaggccctgtctctagagatgatgatgatgatgatgatgatgatgatgatgatgatgatgataataaaactattcacaagtgatttttccaaaaaaaaaaaaaaaaagtgagggtatgaagtattaactactctttcatatatatatatactttttttttttttttttttgagatggagtctcattctgtgacccaggctggagtgcagtggcatgatcttggctcacggcaacctacacctcccaggttcaagtgattctcctgcctcagcctcccgagtagataggattacagaagccaccacacctggctaattttttatatttttggtatagatggggtttcaccatgttggccaggctggtcttgaacgtcctgacctcaagtgatccgcctgccttggcctcccaaaatgctaggattacaggtgtgagccagtgcacccagcctaccctttcctattaaggagaagtgacttgcctttctccttacctctgatttgactctccggagagtccacacagaatgcacattttgaacagcatcataagtcattacaatagaggggtcagtattgaggaaaacaattttcattgcatgatctacaacatattgcacccgtgatgaaccaaaaagaccttaaaaataaaatagaaaaatcaggtatagaacaatgggctttacaagactgatatttatgaacagagctcttaaaattgttaaagataaagaacaaccaagccaaagagagcacaaaatttattactatcttaaataattaactctgaatttttaataaatttactttaggcatcaacttccttaaaatacattaaagatgagagcattacaagttttagcttcacatacatgctgttgctaaatgttaagatttgtgctgactctcaccattacacgaatcagccacaggtaaaaggtcgatgatttcttcaactgacttatttataaattgcactcaactattctgccaagtttgacttccttattggttctgtttttctgtatgaaagctgtactctataattactattcagacagtgccgaacagtacactgttgtttctgctttactagttacacatgcaaaataaggtttttcccagtgagttcagcttttaatctaaagtaccatggactggtctccatatccttatttgacaggaaatgtttcccactcagttaaaatactgaaaaattttaaaatatgattctataatcataagaaatactttataaataaaaatcatgccaccatctcaaaatatctactattaatacattagagaatttttggtttttttcatacatatatacacactttatacatttttacaaaattataatcatactgtgttatttgtatcctacttgacatcacaaataagcaacttctagttcactaaatattagtcaaaaatatgatcaataatggctacactcctccctccagtccgtgcctccaagatgacaaagaaaagaaggaacaacaatcatgccaaaaaggggcacagccacatgcagcctattcgttgcacaaactgtgcccgacgtgtgcccaaggacaaggccattaagaaatttcatcattcgaggctgggcaggtggctaacgcctgtaatcccagcactttgggaggctgagtcaggcggctcacgaggtcaggagatcgagaccatcctgactaacacagtgaaaccccgtctctactaaaataaaaaaaattagcgggtcatggtggcgggcccctgtagtcccagctactcgggaggctgagggaggagaatgatgtgaacctggaaggtggagcttgcagtgagcccagatcccgccactgcactccagcctgggcaacagagcgagactctgtctcaaaaaaaaaaaaaaaattcatcattcgaaatgtggtggaggccgcagcagtcagggacatttgtgaagcgagtgtcttcaatgcctatgtgcttcccaagctgtatgtgaagctaaattactgtgtgagatgtgcaattcacagaaaagtcgtcaggaatccaccttgtaaagcccacaaggaccaaacacacccaccaaagcccatgtaaggagctgagtccttcaacactgaagacaaggccaggcgtggtggctcatgtctgtaatcctagcactttgggaggccgaggtgggtggattgcctgagctcaggagttcgagatcagcctgggcaacagggtgaaaccccatctctactaaaatacaaaaaattagctgggcgtgatggcacacccctaatcccagctactagggaggctgagacaggagaatcgcttgaacctgggaggcagaggctgcagtgagccgagatcgtgccattgcactgcagcctgggtaacaaagcgagactccgtctcaaaaaaaaaaaaaatgaaaataaaacgactaaaaacagactattctccagagaaaaaataaaatggaaattgtacttaaaaaaaaaaaaaaaaaaggctgcgtgccatttaatcccaggctctagtatgtttattcgggttgtctgcaattagtaacaacataaaatttgaactttttctgtaaaagatcaaagactaaatagggcagtttgctgtccacatactgactctatcacataatctttgttatttcctacaaccctttaaaaggtaaaaaccattcttatgttgggtgcggtggctcacgatgtaatcccagcactttgggaggccgaggtgggtggatcacctgaggtcaggagttcaagaccagcctgaccaacatggtgaaactacgtctctactaaaaatacaaaattagctgagtgtggtggcacatgcctgtaatcccagctacttgggaggctgaagcaagataatcgcttgaacccaggaggcggaggttgcagtgagccgagatcgcaccattgtattctggcctgggcaacaagagcaaaactctgtcttaaaaaagaaagaaaaaaaaaaaccattcttagctcacaagctttacaaaaacatgctgcaggccagatttagcccatggcctacagtttgccaagacataatacagaagataaaaagcagctaggcacggtggctcacccctgtaatctcagaactttgggaggccgaggtgggtggatcacctgaagtcaggagttcgataccagcctggctaacatgatgaaaccccatctccaccaaaaatataaaaaattagccaggcatggtggcgtgtgcctgtaatcccagctactcgggaggctgaggcaggataatcacttgaactcgggaggcagaggttacagtgaactgagatcacaccactgcactccagcctgggccacagagcaagacccctctcaaaaaaaaaaaaaacccaaaacaacaacaaaaaataaactttacttcatctaagtatcattcatttacttattaattattaaagaacaaagcatctacaggtaggttaataaatatatcggtattcctcactgatttatatgccttatttttactaaaataactgttgagcagttaataccatgatattcaagaaagtcaaaatagaagttatttttgtaaaatgtttacattatttttataagtcagttttcatataagcgcctttataacctccctcaccaaagtcaaaaaaaaaagagcttatctaaaagaatatagaaatacacttacttccagatttacaaacaagtggagttatttcatctagtgggtgcagcatgctgaacatagtaggtaaaggttctctagcaataaacaaataatcaattaattaccaatacgagtatgtctgtgcacaaattttgcacttctattgaaaagaaatctccagattacatgagcaactagaaacctactatctcaaaatgcaatcttctaaactttgtacatactatttttcacattgtcttctatttcattcctagaaatctctccccttagagtaattctatcaatgcacgaacagagggaaatcaatatagccagggaatttctgcaaacagcagtcatcacagtacagaacaaatggagtaatgtgcataaagcggtctttttttattgacctctcttactggcagtgtgtctttggcagctaagaaagaaatttattctcccatatctgctgacaaaggaatgcattttttaaaaaaggaagaaacaaactacttcaagtaaattaagtctgctttttttttctgagatggagtctcactctgttgcccaggctagagtgcaggggcatcatctcggctcactacaacctccacctcccacgttcaagcgattctcctgtatcaacctcccgagtagttgggattacaggcacacgccaccacgcccagctagtttttttgtatttttagtagagacggggtttcaccatgttggccaggctggtcttgaactcctgacctcaggtgatccacctgcctcggcctcccagagtgctgggattacaggcgtgagccaccacacctggccagaagcctacattttttaaggaattattttttttagagcgaagacgggctttctttcaaagcataaagagatgaaaatctatcagcaatttctttaagacttagcaagtgcctacctcttgcaccacaacatgcctgacaggtgctgtatgctgctgcccttcggtgtgctcataattcatagggggcaagataaacacgccgctagtaaacatctgccatttattgcatacttaatacctactaggccctgtgtcaaagcttatatacatttagctactttaactttgcataagtcctaagaggtaaatgataacattcctgtaacgcgtaaggaaactatagctaagaaagctctaatgatctgctcaaagcagcacaatgagaaaatggcagagctaagaactgaatcttgttatttattttttttttgacacggagttttgctcatcgcccagctggagtgcagtgatgtgatctcggctcactgcaacctccgtctcccaggttcaagtgattctcctgcctcagcctcccgagtagctgggattacaggcacctgccaccacgcttggctaattttttgtatttttagtagagacagggtttcgccacgttgggcaggctggtctcgaactcctgacctcaggtgatccactcgcctcggcctcccaaaagtgctgggattacagacgtgggccaccgcgcccggccaaatcttttttgaagccatttatttgcatattcaattttaccacttagattgggaaaaaaggctaattaagtgccaagtgcgtagagttcatgagtgtacatacaggctgagtatcccttatctgaaatacttgggaccctaagtgttttggattatttaccttacactaacggttgagcaaccctaattcttttgggggtacaagtggcttttggtgacacagaattatgtagtggtgaattctgagattttagtgcacctgtcacctgtgtagtgtatgttgtatgcaatatgtagtttgtttatcccacaccttcttcccaccctcctccttctgagtctccaaagtccatcataacactctgtatatagcctctgcatactccttgcttagctctcacttggaagtgagaacatgcagtatttggttttccattcctgggttacttcacttagaatcatggcctccagttccatccagcttgctgcaaaagacattatttcatttcctcgttatggctgattagtattccatggtgtatatatacattttctttattcactcattggtcaatgggcacttaggctgcttccttatctttgcaattgtgaattgtgttgcaataaacatacatgtgcatgtatctttttcacataatgacttttatttcctttgggtagatacccagtaatgggactgctagattgaatggtagacgtacttttagttctttaaggaatctccatactgttttccatagatgtcatactaattatgttcccaccagcagtgtataagcattccccttccaccacatccatgccaacatctattgtttttctgactctttaataatggccattccttaaagagtaaggtgagatctcactgtggttttaatttgtgtttctctgatcattagtgatattgagcagtttcatgtttgttggccatttgtgtatcttcttttgagaactgtctattcatgtcctttacccactttttgagcttctgtcttgctgatctgagttccttatatattctggatactagtgctttgttggatgcatagtttgcaaatattttctcccactgtgtgaactatctgtctattctgacatttcttttgctgtgcagaagctttttattttaattaggtcccatttatttattgtttttgttgcatttgcttctggtgttttagtcataaattccttgcctaggccaatgtccagaagagtttttccaaggtgatcttctagaatttttatggtttcagggcttaaagcctttcatccctcttgaactgacttttgtataaggtgagagataaaaaaaacccaatttcattcttctaaaaaaggtatcagttttcccagcaccatttactaaataggatgcctttcccccaatttatgtttttgtaagcttgtttgtcaaagatcaaatacttgattacaagtatttggctttatttctggtttccctattctgttccattggtctatgtgcctacttttataccagtaccatgctgttttgctaattataaccttgtagaatatgtgatggctacatacttgttctttttgcttaggattgttttggctattttgggctcttttggttccacatgaattttagaattgttttttctaactctataaaaaaaaagatcttattttgatgagaattatggtgaaatctatagattgcttttggcaggatgatcattttcacaatatggattcttcaaatccatgatcatgggatgtgttaccatttgtttgtgtcatctgtgatttctttcagcagtgttttgtagttctccttatagagatgattcacctccttggttaagcatattcataggtttttgtttttggctctttgctgctcttataaaagggattgaatttttggccaggtgcggtggctcatgcctataatcccagcactttgggaggccaaggtgggtggatcacctgaggtcgggagttcgagaccagcatgactaacatggagaaaccccatctctactaaaaatacaaaaaattagccaggcgtggtggtgcatgcctgtaatcccagttactcaggaggctgaagcaggagaatcgcttgaacctgggaggcagaggttgtggtgagccgagatcatgccactgcactccagactgggcaacaagagcaaaaccccgtctcaaaaaaaaagagactgcgttcttgatttgattttcagctttgtcattgttgctgtatagcggtgctattgatctgtgtacattgattttgtaatctgagactttactgaatttatttatcaaatctaggggtcttttggaggagtctatagggttttctaggtatataatcatattatcagcaaatagtgatagtatgacttcctcttttcaaatctggatgtcctttatttctttcacttgcctgattgctctggccagaacttccagtactatgctgaatagaaatagtgaaagtaggcatcttagtcttcttccagttctcagggggaatgctttcaacttttccccattcagtatgatgttggctgtgggtttgttgtatatgacttttattaatttgtggtaagtcccttctatgcctagtttgtttttatcatcaagggatgctgaattttatccaatgcttttttctgcatctattgagatgatcatatggtttttaattgtttatgtgatgtgtcacatttattgacttgtgtatgttaaaccatccctgcatccctgagacaaaacccacttgatcatgacatatctttttgatgacagcaaccctaatttgagaatccaaaacctgaaatgctccaataagcatttcctttgagtgtcatgctggagctcaacaagttgcagattttggagaatttcagatttttggatcagggatactcaacttgtactgagatgagagaaaatggcatatatctatgctgtcaacatgaaaattatcatcatctcaaacttttagataaacctcagaaccaacacaaacacacaaatcccaagcagtaatattctgaagtgaataaaatgaatacctgggtgaacctggaggtacttcatgtgaagaagcgcttcgttcaaacagcaatccatatttagtgggccaaacatttgcaacctttcaggtaaaagggtgggaaaagatagaagtaagagaacctacccctttataaaatgttttaaagaaacattacagaatgttttattttccaatttagtaatagctttacaaagtaacataatcattaaatacggtattttcttaaaaagtaatacaaataagcaactctaagataaaatcaaatctaataaagaggagttgttcaatgtgaaattcctgccactggccaggatcagtaacaaaatgacaatgtgttaacaatagccctaggcattaaaaagacgatgagtaacaaaaaaagactggtgttattcatatgccttatttaatataaccaaaagttcttaggtatcatttaaaccaacaaacacataccacagaagacttcctaatttacttcactaaataacttattttcttgtgaagtacagaaaaatggtaagccactaaagctgccaaaatttagttattttgagtaaaaataacatttttgactactacgaaacatgagacataagacatgcctctaaaaccaattaattcaaaaatgttctccaacaaaacccccccaaaatttgaaacacttgtttacctgaaatggtaatgaagctatgtaatcctttccttctatgctatgcatgttaatacatgagctttgcaatatacatatgcatttttctacttcattgctacctgaaaagaaagggtacaacaagacttatgtgttttttccctcaaaggagttcaatcctaacagcacaaattatttaatgcacaatataaagatgcttatggtaaaccactattactagtggctacttcatttgaatgaaaaatacaatgagataaatatttggaatcatcataagaaaaataaaatttcaaaaagaaacttactgtaggccttttcagacttatcctgtgatataatgaagtcacaccacaatgcctaaaatcaaaacaaaatgcttacctaagaaaattatatctaaataatcatctattaactaatggcatctaaataataataatagcatctacgtaataactttgcctcctcagctcaacatgtacaatcatgggaacaaaaagaataagaaaaaataaattagagtaataaatgataaatatgataaggaaaggcaaaatatgtttacaattaaattttatgaaaagatccataggaattaaaattttaaattaaaaaaataaattttacaaaaagagaagacaagaatcaaaaaatctaccagatagaaactttgcagcaaaaattcaaatagtagctcaaaccatactaaaccctatatcctctacaaaactaaagattattcaaactttataatctccagattaaacaactgatcttagactctctctagactgacttttgaaaaagtctttagaaaaactaactcctccctttcttaaaagcccatcttacaaaatataaactaggaaaagctattaaactttaactgacatacctggcaatcacttattatttaacagcattttgtgtttttttttaaactgtggtcaaatacacacaatatgaaaattaacattttaacaatttttaagtagacaattcagtagcattaacattaaattgacgagcttagtacaatttgtgagcttgtacaatactgcacatttccagaactttttcctcatctcaaacagaaactccgtgcccattaaacaatactccccatttcccaatgccctgagctctggtaacctctattccactttccctatgaaagggcctgtgctaggtatctcatgtaagtgaaactgtacatttgtccttttatatctattttatttcacttaacataatgttttcaaggttcatccatgttatgacatgtatcagaattttatccctttttaaagctaaacaatattccactgttagcatataccacatttgtttatccattcatctgtcaatggacatgggttgtttctaccttttggctatcataaataatgctgctgaaaacactggtgtacaagtatctgtgaatccctgttctcaattcaattgtgcatatacctagaactggaactgctggatcataatggtaattctaagtataacttttctttcaagagatggggtctcactctgtcacccaaactgcaatgcaaggcatgattctagctcgcagcagcctagaactcctgggttcacatgacccccctgcctcagtctcctgaacagcttgggagtacaggcatgcaccaccatgcctggctacacgtgtaactttttgagaaatcgccaaacttttccacagcagctatgttacattcccatcagcaatgcacaggagttccaatttctggacatcctcaccaacatttgttatgtttctttaataacagccaacctagtaaagtggtatctcattgtggttgtaatctgcatttgcctaatgattagcgaagctgagcatcttttcatgtgcttactgaccatgtgtgcatctttagaaaaatgtccatttaagtccttctgcccaattttttaattgggtagtttgttttattgttgagttgtgggagattttaatggttaagaaatgaaaattcaggaagaaaaccatgcatgagagctgtgctccaacctgaaatgtccaaaatctacaatgcaccgattacagtctcaacttcctttgatgaaatcccatcctctcagcctctaaaagtaaatattttaacatctcttttatccctgatatctaagagatcactaaccccttccacatctccctctgctttatcaccccttctttgccaaggcaccaatcttttacctgaacagtcacaaaatagtgcccctgacaacagtctccctcctctccagtcaatcctatatatatattgctaacaaagcaatctcttctcaaaacacaaaattgatcgcttccattttaaaatccttggcaggctcccttcagcacacagtttaaaatccaaattccttggtttatatacaaggccctttggtctgtatactgccagcatccacttgcatctctccacacccacacttcgtgtacagccattctgaagtttaaaaagtcatctttttccataattctttttgctgtgatttcctctgcctagaatgcccttctgccaccattttataacacaaatagcatcttctttgaaaaaccctccctttggcactcagtcctttgggctctcatcactctgtggacaggtagttattatacagcattcagaatacagcatttcaggtgatctgtttgttctcctttctaggctatgagtccttcaatggcagaaactacattcacctttgtagccccagcataatggctgaaacagagtgagactaaatacttgcagaagaccaggcacagtggctcacgcctgtaatctcaacactttaggaggccaagccaggaggatcactagagcccaggggttcaagaccagcctggacaacatagtgagacccccatctctattaaaaaacaaaaagaataaatgaaaaaataaaaagaacaaccaaaaaaaaaatacttgcaggataggtaaaacaatgaacagataaaatctgagtcacatatacctgatattatttcataaacaaaatagaaaattatctttctccatattagcaagaagattaagtaacaatatattttccagatcaaaagactgaaattccaaatcttacaattacacttacaagtgatcttaagataaaggagataatatatctaactgcacttccatagaatctagtaaataggcaactgttcttggagaaattaagatgaagatatagaagcaaagaactacttggatatcatcaaatgcacttttcacatctatactaactatatgaattatatgggaaaaaatttaccatcaaaaagatcactggcttcaacactccaggacacaaatgctttcacatatgccctcaaatgttggaataatgattcagtttatcctttccaataaatagaatacagtactcatcaggaaatagttaacggtaggcgggaggagtgggaggaagcagtatccagatacaaagatttcagcatttacaaaaatgaaacttaacattagtcaaagcctccaaaacctcgtcaaccctaattcaactacaataaatgcattagttcttcctccaactttttgttataaaaattttcagtaagaaaagttgaaataatgcagcaaacatatttcacctatatccaacaatcatgaaaattttgccatatttgtttgtgtgtgtgcatttgtgtacatatgggattttcggaatgggaatgctgactgtttaaaaataaattgcacacacatcatgacatttcacccctaaatacttcaccatgccttttctaaaaataaagatgttctcctataaaaccataaaatcatcgtccctgagaaaaaaataatacttctctaacatcagctactggccagtaattttcaactttcccaaattttccccaaaaatatctttttagctagaaaaccaggactcaatcaaagttcatttaacaaggatcaaaaaatactgcatttggtgatgtctctttagtctctttcaatgtagaacagtccccacctttttttctttctccgtgacttttttaaagaaaccagaatgtagactataaactttttataatggaaaatttcaaataaatacaaagtaaacagaataggataatgaatccccatcagccagttttaataattatcaagcttggctgggcatgatggctcacgcctgtaatcccagcactttgggaggccgaggtgggtgggtagatcacaaggtcaggagatcgagaccatcctggctaacacagtgaaaccccagctctactaaaaatataaaaacaaaattagccgggtgtggtggcgggcaactgcagtcccagctactcgggagggtgaggcgggagaatggcatgaacctgggaggcagagcttgcagtgagctgagatcatgccactgcactccagcctgggtgacagagcaagactccatctcaaaaaacaaataaataaataaacaataataataataataaagctttagccattcctagctatctatttccttatctcatggtattttaaaatataattctctattgcctatatttcctataaataggaagttaggtctaaatattcatatttttgggaagaaaacttagatgacatcatgtacttcattctgtattatagctagaagcacataatactccttcatgtcactactaattatgctaaactcaatcacttgattgaggtggagactgacaaataactccaaagtagaggtacatttgttccttcacatttaccaggtaatccacagggtgatgtgttggtgccatggtaatattctttcaaccaacagtgttagtatccatttacaatccttgttggaatcaattattgcactggaggttacaaaatggtgatattctaattctacaattccttttacacttattagctagcattcttctctaagtacaagttttccttcatcaaatggagatgaactgcatgtcttcctgaaaaaatatggcaaatgcttaattctttccctttcattatcaactttcagaacagttagttataacagccaactgcaatggctgcaaagcagattttttcctttctctctaccattatgaatcccacgatttttatttattcaaatctttgcaatcaattatagtaatcatgtgttaaaatatttctgtactcttcatgttttataggtttttgctggcaataacaaattgaattacataaggacagagtgtttaaagattaccattaaagtgacaaagaagagtgtaaaaaaagtgatgatataaaaataaaattaaatttttattttcctgccattatcttcacattatattatgtcatgttacaacgtacacccagctgctgagatcattaggctggttttatcatttctgttaaattttaaaacaaaacttttttttaattgcattaaatagtgaatcaaatgctaaaattcaaatcaactcacctgctgaacaggactgtcaactgtaaatgctttataaactgccaatgcctggcttttacttcctttgctccatatcaccatatttccagcaacatagagttcctcatcatagtccacatcttctccaatttcacttactcctttccttaactgccagctttccttaaaaattaacacatgtaaaacatattcaagcactctttttttgttcttcaaaaatctggaacaaaatttatttgcccatggagtaagactcaattcaaacacaactcctacaaagtttggtacactgattaacggaggatgtggatatatgcattacactacagaattacatgaagaatttactcaataattctctatattgaatgttttatattattcctctatattactctgccaaaaacaaaaacgaacaaaaagtacaccttctctatagttccaaaagtcaaatcacatgcttgggagactaaaaggacatattaagtatatgaggtagggtagggaaaggacagtgaggtgcacgtgggaatcacttggggagttcacacacaaatgcagacttcctgcttcgcaatcacatatatattcaccttcttttcctttgtcccacccaccaaaatgaatggaagaaagagaagtttccatttgtaactacataggctttccctccccgagattttagtatcccaaagggatatgacaatggaataaggcaggagggattcattttctgacacacacttaacatctcattcctctacttaagaactattactcgccgggtgtggtggctcacgcctgtaatcccagcactttgggaagccgtggcaggtggatcacctgaggtctggagtttgagactagcctgaccaacatggagaaatcccgcctctactaaaaaaatacaaaattagctgggcgtggtggcacatgcctgtaatctcagctactcgggaggctgaggcaggagaatcacttgaatccaggaggcagaggttgcggtgagctgagattgtgccattgcactccagcctgggcaacaaaagtgaaactccgtctcaggaaaaaaaaaaagctattactctacctacttttgtggcatttcttctctcctttagaaacatgtaaatcttctgcagcagggactacttctaatctctaccatttaatcattagataacatgaaatctggtccccacatattaagtgaaaagaaaaaggtttaaaatggacaacaatcatactactgaacctgactcacattataacaccacaagttggccgggcacagtggctcacgcctgtaaacgcagcactttgggaggccgaggcgggtggatcacctgaggtccggagttcaagatcagcctgaccaacatggagaaaccccatcactactaaaaatacaaaattagtaggggtggtggtgcatgcctgtaatcccagctactcgggaggctgaagcaggagaatcacttgaacccgggaggcagaggttgcggtgagccaagatcgcaccagtgcactccagcccgggcaaaaagagcaaaacttcatctcaaacaaaaaaattgaaaaataaaaaataaataaaaccacaagttatagagggtatctaaataagtcgctatgacaatgtaataaagtcattattttcaacatttattgaaattaccacaccttaactctactctagaagtggcatcacaccgatctctcagttgcatcttagtagccttaaattacaagtagattatatcactctacatttcaaaaacacaatgggaaactcaatggaaccttctgtttctcgtggattgtaacctcctgaagggatcccaccaagccagcagcaccatcagaagaccataattcagaagctggctgcagctggcgaagttgaaggttcaaagcattagggtggtgcttgcagtggtctcgaccaaaaggaacaaattcctgcaaatcccttgctgcaatcatcgttgtcctttcttcatagaagttcgacatgggttccaaatatcaacattatttctgtatgaattcaaacacattctggtcagcttccagactcaaaactagaataaaaataccataaacacacaagtcattaatccttacatgggtgtcaagtaattatatcagactggtaagtatataagttggtcataacataaaagggcattctagatctgattcagacagttgcaattatcacattttagtcacagactgacagttaccactataggaaaccactgagatgcaacaagtacttatgtcccgcaccacctatcccgtgtttcccactactatacgctaatttttccatactttatatatgaagtatttagacaagttgtattctatggtcccataactacatggcttttcaacatttaaggtcatttctggttagatgccagaacctcatttgaaaagtacatctaagggatcattgtcatattggaataaaacaataaaaaaccacacattactctaattcatcagaggttgaactgctttcagctgaccaatctacaaaagacataggttttcaaatgtcttaagtagctgtgacacccccaatcccacctaaatatataactacaatcaatttcaattattggtcgaaacccaaagaaccgaggcatgaataactctagccatggaacagttatgcttgcagatttaagggtactaggttttaattaattattacatctaattaatctaattattaatctattacagtacagtttattactaaaaaaatgtggatgaactgttaaagccttcatcacaaggttaggtagcagccaggctttagacaaaagtacagataagcataattagattgtccttcgatccactttcctgtacctgtttatatataccatgttcctatagacagcatttttaatgttaggagcctaagacttttgagatgatgcaagctagtcttaagaccccatcaaggaaccacattagcatgagaatgtggtttatctctctgtcctatgacttcatccttcattctctgaccaatcaataccttaacccactaccctctctttaaaacctctggaccgggtgcggtggctcacgcctataatcccagcactgtgggaggccaaagcaggcggatcactaggtcaggagatcgagaccatcctggctaacatggtgaaactccatctctactaaaaatacaaaaaattagctggacttggtggcgggcacctgtagtcccagctactcgggaggctgaggcaggagaatggcgtgaacccaggaggcggaggttgcagtgagccgagatcatgccattgtactccagcctgggcaacagagcaagactctgtctcaaaaaaaaaaccaaaagcaaaaaaaaaacctctagaccttaactctttggggaggctgacttgaagtttcctcagtctcctagttcggtggccctgcaagtaaaacactttatctgctgcaatccccgttgtttccgtgtattgacttgctgctcatagggcaagaatcctatatggttacacaaacagccaaagcctatgtagttcctttgcagctcctccaaagccacaaagttattttgctgtgaattaaatgttattcttggccaggcacgatggctcacgcctgcaatcccagcactttgggaggctgaggcgcgaggatcacctgaggtcaggagtttgacacaagcctggccaacatggtcaaaccctgtctctactaaaaatacaaaaaaaaaaaaattactcaggcatggtgtgggcgcctgtaatcccagctacttgggaggctaaggcaagagaatcgcttcaacctgggaggcagaggttgcagtgagccgagatcgcgccattgtactccagcctgggggacaagagcaaaactccgtctcaaaaaaaaaaaaaagaaaagttattctggatataattatgtcacaaaacatgacacaagttttgttcttcctcctgctagaaataaatgagtactgggacacttgaacttggaacacaagtaaaaagtgccttataaaacttacaaggggcagggcgtggtggctcacgcctgtaatcccagcactttgggtggccgagacgggtggatcacgaggtcaggagttcaagatcagcctggccaagatggtgaaaccccatctctactaaaaatacaaaaattagccagacagtgatggcgggcgcctgtaatcccagctacttgggaggctgaagcagagaattgcttgaacacgggagccagaggttacagtgagctgagatggcgccactgcactccagcctaggagacagaacaagactccttctcaaaaaaaaaaaaaaaaagaaaaccccacaaaaaaaaaaaccttaaaagaaaacaaaattcagctggtcttcctatattttattcaacagaataaccaacatcaacgaacttttgactttatgaaactttagttctgcaattttataatgttattttcttataactttgagagaaaattacagaattgttaaagaattatcattttgtaccgattaatgccacatatttaatactttttcagtaccccaaacttttagaaatgtttttacttgttaggtgcaacataaacagctacacgtaaaaatactattaaatttatatgctataaataacagtatcagcaatgattcctacaaacactaccctgccaaaaaaaaaaaaaagagacccaaatgcacactaacgggagcttaagtctccacaagagcttccccagcctttctagaggacggtgaaaacaggctgagagcccgaggctcagaaaaacagctcagaggggctggaggccagtctgaaagctgaggctgcacatgggatgctacgcacagctcaggaaagaggttggcaagcaggagccggaaggagcaccccagcccgcaggccaggagcgcccgcaggccccctcagccccggagcacgctcaaggccctccctcgggttcccagtaccccgggtttccagacctacggccaccaggggaggctcggcctcgggacgggtgcgagagtcacgcggcgcgcgacagaccaccaagtgctgcggtacggcgcccgcacctgtataactcgggacgcgtcaggcgcggcgagccccggctgctccccggaggcgcaggggccgaggaggcccgagggcagcggcggggtccttcacagtgactcttgggccgcagcagcttctcattccctctccctcccctattctggaggaagaacgggcaacagcagcgggctcgagtgctaatggcaggaaggcgtgcgagacgttcaaatggacgcg

SEQ ID NO: 1166 - DNA, 144161 bp, Homo sapiens
actgcaaacgtcaagtggtctccgccttccctgggttcggagcttcacttgctcttgagctctgcggtccggcggatttcgcggggcccaggggatggcggggagtgagatttggccagggtcatttcacactgccgggcctgcagccacgcacgcagctgctggcccggctgaggctggcggctagggagaggcgccagggggtcgcgcacaggaaggtatcggtgcaccctgagcaaacactgctcgcttccaacgctcactgggaacaggcttcccgggaaggtcccaaatctctccagttccgctcaccctgcgggcgggagcgcggcgcccgggtgccccacctgcgccgggcggtcggctcccgctggccggagtttgcagacttggcgctcaggccgattctcccggagttgggccgcgcgcgccgggccaatgagcgcgccccgcggagggctccgctccccccgcgcgcgctgattggtcccgcggccctcgaggccgggccggccgcggctgcgggcggcggccagtgcccggcgcgagtgggagtggcgcgcgcgcccctagccgccccccgcctctccccgctgcgctccctcgctccttccctgagctcccgggctccggcagcgggctggcggggcgccgcattgcacactctgggggcgccgcagtgttcgtgggatggggcagcgggctgcagctggcggccggaatccgcgcgcagcccgggtgagtagaggcgggcttcccgggagagcacaaaagaacaggggattggtgccagcggccccggcttaggcggggcctggccaaggcagggagtgcgctgagtccctggaactacccgatgctagggcagtcccctggggccagaggaactggggtcccggcctccggcgttttgcccctagtgggcagagagccccgcgagtagcctggacgggtccagaggggcgtgtgtactcgtgtgtgttgggctggcgcgtggagggtgggatggaaaggtcaggagctgccaagttcaaggctggaggaacctttcccaggagtaattcagcatcttctcacggcccaacatgcgtccaccaggaactccagccggagggagttcctgggcggcggactggcagcaccccacatgttgctgcggggcggggggcagtggcggtagcccggctgcggccacccggagcctctaagggaggtgcagtgtgctggaggtacctccccgccgctgcaagaccacgctaggcctttcagccatccaccccgacaacccagggaagggaccatccacccacagagttgggatttggcctgggcttgacttggcgacctgtttttctctccggtaacagcagttccgttgattcacatttggctaagcgttcagttacaacctaaagctcactatctgacggtctgactcgctctgacccccaccatatcctcactatctctaccgctgccctcctccagtcccctctcccgccccagtatctgccctgctcctcactgcggggctcaaaacttggtgtttgagcatgattgccttcggtgtggtccttggcattttcaagtgtcacaatcacatcccgtttcctagaggactccaaagacttgttataatgggatcgggggagagaattgggtgggggggaatggaagagggtctttggtagtcacttgttggaagaacagcattgacctcccagagcatatgacaaaaagaatgttaagcttctttctatggtaacctacccaaggtgtgacctccaaaattcaattttctttgtgggaggcaagggagtttagattctccagggggaagcttatttcttgttaaattgacttgcggtgacatacacactgttctgctctgctctggccagccattgcagatgccatgatattattagagcaattcccttaaagccattacattttctttcgagtgagaggaactcgagctagctgtttaaaattttggatctgcaccttatttctctagaagacattaatggttactgtatatgcgctcacgtgtaccaagtttgcaaaaggtatttgtgcaatcgcccatgaaatgggttaatgcacatttatgttaaacccatttaaatgtaaaacatctatctgttttcaattttagtttccacctcgaccaaaggcaccagactgaaataagacttaaaagaggcttccttgtttaaatagaggtttatagaactctagtcctgagagcacacagtaagctttctgagcttgtaggcacacaaagcttgttaaaaattgtgaaatggttccttgagttagaaataatggaaatgcttccagaccaattaagacagacaattgatgaagctacactctcaagctgttgacagtctttgtaaggtgaatgtttatagtacataatgcataaatcgggctgattctaggcaaataatatcaagtaaaaaaccataccatgtgttgtatcatactggatagtttatatggcatattgaaatctactattaaagtgtctgaggaaatcatatctttatcatccccatttcacagatgaaacaactgaggctttcaaagattgacttttccaagatcaatagcagagttcagtcaagtgtttttcaaattctttcctacctcacccgttcccttccttccttcctttttggtgtttacctacttctttgttgtttacctacttctgatttctgcacctctttttactgtttaacccatagcttgagggaccattgtgaatcatccccaaaaggctttgctgtctgctcaatatcatttagctcccactaaggtgagggctgataaagaattaaggtgaaaactaggaatagttttaaagagctacccttttcaaagagatacgttatttttgctaatgagttgttaaaggtacatataatcaaacccctaaaggatgatgtcctaattgtaatgtttcagaaagacaagtaacagtaggagagatgtgtgagaaatatgtaagtctcctattttataaacacactccttataagctctgtagacgattaacaatagaaataataaatgaatatctcattagtgctattcttattttaaaaagaattgacaaaatagatgacttaaataaaatcagaactactctggaaacacaaaaagcacccacttatcaaaagtcctgaaatcctcattgactagtgtacaaatgtagcagaagacattggttagagagaaatcatatttttacttgcaaagctagcaataagaagcgtacagatatctgcctatctgattattttttaagggctcatcatctgcaaatcttttcttggaaaatgattgcttacaatatttacttgtgtcattgcatactatttattaatgagattaatctcatttgcaataacgtggttaagtgttgagcttactactagtaagtcttggttaagtatgtgggctttggattcaagtcttgtcttcacatacactaactgtgggacttcaaaaaatgatagaacttctctgtgctttagttttcttatgtgtaaagcatgaataatgcacctacctcatgcagtttttaaaatttattcatgcagcaaatattcagcaattgcctattaggtaccagctctgctctagatgctagggatacatgtgcaaactccttgctaatgaagtttaccgtctggtgcctgaaatctaatgacacaatgcatttaaaatgcttgggatgggaccttacacctaccaaatgccccgttattgttagctgttggtatcatacattctttcaggaactgttcagagtgcctaccagatgtaacacagattgcagcatgtaatgatgaatgatatgtgtttcaattcaattaagtcttctaatggaagaggggactccaaagaaggacatcaagagtataatcagtctctaaaagggaattcaatgctgatatgttagggaagaaatgaaaagaaatacttaatttacccataagaaagtgggaagcatacgaattaccttatagaaacccaaaagtgataagaaaaacaagtcttgtacccaagctctgtaaaacactaaactcatagtgaaaacacatagggaaagtaaagaaaagaaaaagaaagcttacctggatacatgtaatgaaaaaggaaaatttgaagggtcagtttattaaattgaccttatgaagggcaacagatcccaggcatactagaaatgggataaccaaaagtgaatttgttaaaaaaaaatccttgcaatggatttccaaaacgataatgaaagtcccttaaatactgtgaaataaggattgtggaactactcatctttcatcataccaaacatgtactgggagataaaaagagataaaacagcgtgtaaatgaattctttgcttctgtttttgctgagtaatattcctacacccaggctttctcaagcaatacacacattggaggtaatagatcaagaagtggcaagtgctgaggatattccagacctaatcagcagactaattacagataaatcaccaagactagatggccttcacctaagtatattgaagaagcctggtgtgtacgtgacagcaatctggggtattgctgggggattgactggtgtccttgggggctccagtcaggggaggggtttccagaaggactgggggccaagaaaccagacccgtgtccctgtggatgattgggagatggatattcaaagtaaacacagattacagcaagtaacgattttttttttttttttctgaagaagggggattgacgtattagagttaaaaaaggaaaatacagtcatgcacctcataacaatgtttgggtcaagaatgcactgcttatatgatggtggtcccatacgagtatagtggagctgaaaaattcctatcacctagtgacatcttagctgtggtgatgtcgtggcacaacacattacttacctgtggtaatgcttgtgtaaacacacttactgtgttaccagtcttagaagagtatagcacgtacaattatgtacagtacatactacttgagaatgatattaaacacctatgttactgatttatgtatttactgttaatgcaatttatcattatcttagagagaactcctacttatttttttttttaaagtgaactgtaaacagcctcaggcaggtccttcaggaggtattccagaagaaagcattgttatcataggagatgtcagctccatgcgtgttattgcccctgaagaccttccagtgggacaagatgtggtggtggaagacagtgatattgatgatcgtaatcccgtataggcccagcctaatgtgtgtgcttatgtcttagtttttaacaaaaaattttaaaacatgttttcatttaatagaaaaaaagcttacagaataaggatttgaagaaaataagtttgtaccatgtgtttgtgttttaagctaagtgttattacaaaggaatcaaaaagttaaaacatataaaagtttgtaaaataaaaaaattacagtaaactaaggttaatttatcattgaagaaagaaaaaatgttaaagtaaatttagggtagcctaaatgtagtatttataaaacctacagtagtctacagtaacgtcctcagccttcacttctacttcccactcactcacttgccactcactcactcacccagagcaacttacagtcctgcaagctccattcatggtacgtgccctatataggtgtatcttttttcttttataccgtatttttatggtaccttttctatgtttagatacacacatacttactattgtgttacagttgcctgtagtatttagtgcagtaacatactgcagaggtttgtagcctaggaacaaaaggctataccatataacttaggtgtgtagtaggctatacatctaggcttgtgtaaatatactctgtgatgttcacacagtgacaaaatcacctaagatggctctctcagaacatatctccattgttcagtgatacatgactatatgtttgttgccaagtgttgcaggaaatatattttaatgtttcagaaagcctaaccaggtttccgattccagttccctcctcattcatgaccttttcttatgaatgggaaattggctaaggaaacaaaaaacaaaaaatggagatcaataggtatatctctgagtggacaaatagcctcttccaggaagtagtttggggatggtctaatttaacacttttgtaaatgcttatgggtgatatgcagttcttacggtaagtaaaaaccaagctgctaaagttgaactatagaaataacttaaaagatcatctaaataggaagaaaaataatagaagattaaagtcaaaatggaagattgaagataagtgtacttggaaaaagcaatcccaagaacatttataggagatagttttaaattctgttcccatcagcagatagcatagctggctagtagtctctcagctctctaaaacacatgtgtccaccaagttaaagtcagtgttagaaaaagtgtaggttataaaactctgtattaatgtgatgctattttaaaaatatatatggctgaataagtttatataaataaaccctctctatttgttcatctgtgtggaaagaaatacatcaaaatattaacagtgactctctctaagtaatatgggattggaagtgatttttattatcttcttttacctgtgttctccaaattttctagattaaacacatattcttataagacaaaacattatgaaaataagatttagtattataacctcaggtttcatgtagtgttaatagaaagaaagctcatttgattattatttctatgtcttctgaaaatctgtagttgaaaatttttttgcctttttctcccctctgaattccccatgtaaaaagggcagcatgttgaaataacgtgtgtgtgtgtgtgtgtgtgtgtgtgtgtgtttggtgttaggaaaaaatgtggttgatgtgctttttaaaatagaactaggaaatgtaaaaagatttcgtttttacattcaatggattttacattcaaatccataactcaggatttgaagaacaaagttatagaagcattgctgatttctttctagactgtaagcgctatgaggacaggcaccgaatctgtttctttcctttctgactgtgtagtgcttgccttggtgtctagcacagaagactctcccagtaaatacgttggaatgttttgaattgaatgataggattaaaaactctgataagcatgtagaaatttgaaataagagtttctagggcccattgtatcctctgaggtcatatgattcactcacgttttagtttgtttctctgtaagttatcctggcagtctttgtattatatgacccctgggccacaaaagtggtttgtgctggtcatctgggatcctctggcttattctcaagttttgatccagctcctgccacttgcatccatctctcatttcagttggttttgtgctttggggctggtgttttgtttctttccttggctctggattttgtctctctttcagcctttggcttgggttcatcatctttttctcccactgtggacaccagtgtatataatcccagttagctctggccccctttaaaaaaaaaacttatattttaggttcaggggtacatacacaggtttgttagataggtaaattgcatgtcacagggatttggtgtacagattatttcctcacccaggaaataagcatagttctcaataggtaatttttcattcctcactctcttcccaccctttaccctcaagtagaccccagtgtttgttgttctcttctttgtgtccacgtgttctcaatgtttagctctcacttataagagcatgtggtattaggttttctgttcttggattagttcacttaggataatggcctccagcttcatccatgttgctgcaaagtacgtgatctcatttttatggctgcatagtattccgtggtgtatatgtaccacattttttttaatccagtttactgttgatgagcatttaggttgattccatgtatttgcatttaggttgattccatgtatttgctattatggatagtgttgcaacgaacatacacattcatgtgtttttatgtagaacaatttgtattcctttgggtatatacccaataatgggattgctgggtcaagtggtaattctgttttaagttctttgagaaattgccaaactgctttccacagtggctgatctaatttacaattccaccagcagtgtataagagttcccttttctctgcaaccatgtcagcatcttttattttttggctgacccttcttgataagctagaatcttttaaagagtggtttataccacaaactattaaatattaacaattgaatattactgtggtctgaatagtggcatacctccaaaattatgtgttggaacataatccccaatgtaatagtatcaaaaggtggggccttttggacagagccctcatgagtgggattagtgcctttataaaagaggttgaaaggagctcccttgtttcttctgccatgtgaggacacagcaacaaggtgccatccatgaggcagagaatgagccctcaccagacaccagatctgctggtattgtcatcttggacttctcagccttcaggactgtgagcaataaaattctgttatttataaattaccccggctaaggcattttattatagcagcctgatggactaagacaaatattaacacctgatccccagaagggatctaggagtcattgtagattgttctccaatattagcttaataaggcactgtagtcagattattcagtaatatccctggtattgtcagcaggagtcttggcagaagaacagaaaattttatgttgtttttacataaaatctggtatatatgttacaacatgcaacccttattgtcattttcaagaaagacagatagggaggaattggataagagcaataacatggtcaagccagtgcccaggactttgagtgaggacttaggggaagtagctattttctgacgacagaatgtaaatagaactctggcttggaagataaagactcaagggataggagcctagtgtatacattatgaaggtcactgcctgctagagagtcttctttaactaatccgactccaagactaacacagaccaacccaaagactacgtataaccagaaggccatagggcaggaactcctgcttgccatcaggtgcttctctttgagggagttcttgaaatggtccacggctcaggtgtgaagagatgagatctatattggacaggttctggagccatcgtggcttagaagcctcattcccctaggagttgatatctcttgtaactccatagacaaagcttccaaggtctcatagggatgtgcccagtttccagaatcatggccctcagggaagccccaagcatggtgtcctatcaggtaattttagttttcaaccagcctaccaattacagtcatagctgtaacttgttactatgacgtttttactcttatcaggttgctacaataaaacagctagacagatacccaaagtcaaattctcatgcacagttacaagtagagtgaatttgcattatttttcacaaaaattaaaaactagaactagaatacatctgttgatatctgaaaacaagggattttagacagaaagcaatgaggtcagactatgtaatacccctacctcctgtcctgcattcccccctgctcatccttattctctggacaagaggatgcaaagtaaaattaaaaataggttcaaaagtgtttaggtgtatgcgtgagtaattaccacataatggattgttaggcaaaacgaaagtattgggtgtaaaatcttcatcttttgctagaatttttattgaattcttttaattcagattcctgatcacctaaccgaatgaattcacaacaacttttgcagcagttatgacttgttctcagccatagataaaggaattcgtaaacccaggattgtcctactatttctgccttttcttttggaaatcattattgctacttgaactaccaaaaaaagtatatttaagcattccaggtgattaaataacaatgcagttagtgtgtttttgtagtaggattttgggtaaacattttcaaaaaatatttaatatttttatgacctaaaaaagcaggagagataaaggttattttaagcacaatttttagtgccttgtagtataacatattagcccagatgtacatgttacttaaatttctatcaagatatctagaaatactagttcttttatgctgttacagaactttagataatataatcatttacttgcacttataataacagcatttattaccctctacttttacttacatggtttttcatccacaggactctacctgcttgtgagagattatgttaattttccattggcagagaggcaatgtagagggaaggttggaggtctgggctctcctgtagtgtaattctgcctccaccagttgctacctgtgtgaccttgggcaagttatttagtttcctccaattttaccggctacaccattaactagctggctgacctttagccagtaggtcacccactgggcatcatttgcttcagctgtacaaatcaaaaggctttactaaattcccagatgtgtaggaaccaacatatagtttttgacatttaaaattacccattaatgctgatctaataaaattgctttgattaactgaaagtgtggcataatattggtatatagactaaaataaataaacattcaagaattcttgtcttctaagaacatgagacctctaataaataatttaaaaggtgtagcacatccccccagaatatattttcttgctatgtagatcttcactgttctttgactcgccatgtggaatacatttaatttcttagaaaattttcaatcttggagaaaaaaattcactttcaagtgttctaaaaatattgccatttaaaaatactgactttaatagaagtaatatcctgcgtttatatagtggcttttcatggaagatcaaaggaatggtattagaagtacatggtttttcttttatgtataacttcataggagaattttcttttgttgagttcttttaattcagattcccgatctgaattaaaagaactacccgagtgaattcacaaaaagtttgcagcagttgtgcctttttctcagtcaggtgtgtccttggtcaggggtgtccttccatccattattccacaatttacaatgcttctcatccttcaaagcctagttcaatgcagcctccccaaagatgccttttctcctgattccctcatcagtgtaaattttgctcttttacgtatacctgtattttgtagtaacatattctttgttacattctctacattctcttgttacctgtatttttagtcttatttctcatggatgccaacatgaacataatgttttgcatagagtaagccctcagtcaatatgcttaatagaataatgcctttcatagagaaaagctgtaaagatctggggggaatcacaaaggattgcatcttagactcgttgtgctactataacaaaatacctgagactgggaaatttatatcaaacaaaaatttatttctcacacatctgaggctgagaagtccaagatcaaggcaccagctggtgagggcacagtctctctgcttctaagatggcactttgttgctgtgtcctcacacagggaaagacagaagagcaagtgagttaaggccatgtgaagaagtctcttctataaggccctaatcccatttgcgagggaggagccttcatgcataatcacctcttgaaagttccatctcttaatactgtcacatgaccacacctgaattttggagggatcacagggaaaccatagcagattggtttagatggaagggataggttttgcattatatgacaaactgttacctaattttggtccctggatgtccaggaagaacaaatgaataccacaagctatacacattcttcttagagactctactctgctgctgtgtccttataatgaataccttttaggtattgagggtattcacaaaacagactctaagccctgagttgcccatgacctaggactttggaaagttaggtatgatatttttacccttaccctggggaaggcacaaaactattaatgaaggatatgcccccatgacccaaatgctaggccccaccttcaacacttgggatcacatttcaacatgagatttggatgggatacaacacccaaaccatatcagtgggtaatttctatttttaaaatatacaaaagtttaaggaagaaaataatcattccccattttatcacacagatttaattattcgtgtgtaatttctttattattttaatgatattctttttctctgtgtcacatggtggctacctagttatggatacagcatatgttgaatgtatttgatccttatcttcctagagtaaaccagaggccaatatagcaaatttactatgtataaagatgtacactgttcttctatgctactgaaaaactctttcatcagtagtctcccatgtggcctcctatttgtgggagggaataatgtgcatagttagggctggtattttttaaacaaagaaatagacaaggccagatctgtttaatctctaacggccagtgttctttctgttcattcccatagattagaatcacagccaactggcttaaaatgttgttttaaggagcaccaggtgagaggtggccagatcagcatcagctccccacagtcctgataaatgactcaggtttgaactcctcctgttgccaatgttgttattctttggtaaggtgaaccaggcaagcaaaaatcaacatggtacaaaaaaatttttctcaccaaagctatttggaggctcaactttctcaatgaagggcactgcatttcatagatagaatagcattttaaagacatgtactgtctataatggtactttcttctcagttgggaactatttaggagagatctgtgctagaggagacagttttcagctaggacatgcaaattcaagaaaggtccagtgccatagcgtctacaagacgtcttgtagagaagcaagcagactcatttcctatagcttctgggcagttctggcattgcatgtgtgtttcagatctcttccggagaagcagtgtactgaataagatcgaacatggaaaatggaaaggaagagtgggcagagaagaaggagctaaagaacttttaataaagaaagtatcatctactttataatagattaaaaaaaaacttttcgatcctatctgattcctgtcctatcagagaaatccctaaaatgaacaaatttgaggagaatgacaaacatccatctgccttaaattatcttccaaatttctgccactcccagcttcaaagccactcctttggcaagtcattgattcagccttagaagatcactgttaaaagccttccctgaagggaaaatcatgctcgttaatgaatgaatctaagctgggtaacatactcttccagtaggcaagtgaaagctgggggaatatgagtccaagcaaggggactgagatggggaaatagaggaggtaactttttccttgtaagatgtgggtggaaaggaaagatgttgagatctttgcttgtttcccactttcatctaaactctcatcatgctgtttgctgaattatcaaccaccaattagtggtaggttttaggccaagccaggtaacttctttgaacttcagtttcctcaaaatgattgcttaagatcagcacttccaaaggaggacctgtaaggaaaaacactggttctgtgggatattacaggaaaaaaaaaacagtggattaaaaatgtttttgttttttgagttgcaggacttttagaacatttagtaactgaatgttcactctatatatctgaaagaaggtgtgatatataatattcagtgattcccagacctatttgacagtgatactcattttgagggttcatcttgagggtcagtgttttctgaacacaaaatattggactatctggtgtctgacgtccttctatgttttaaattctgtgaatgtacaattagtttgtctctcctcctatttctttcctagccagcccccttgcctcttacctagaactgtttttgtgttgtgtgtaaaccatttgatcaacaatgtactctgttagaaaatctctgcatctactttaagagaagtgcatgttgagatagtgcaaatctgcaagctatgcacttttcccttttatttttatattttagactacattaagtcaaaggcagtcaaaaagcaaacaataaattccccaagtgctgtacaccctgcccaatatcctaataaaaatattgaaacatttatactaatagaggggataatatttcagaaaagaataatttacaaaagacccaggttttattccgacagaggcgtttctaagcaaagcagggcaattaatcatagagctgtaacataaagatgaaaagatgaatactgaatatatagaaaatgtgcgctattcttcccttcatctttagaattacaaaagatgtttatcaccccttgccttaccaacaccaatcttggattttttatttggcttctgcaccagattcacccttgacttgatgaggagcaggtaaaagctgaagtgctttgtgggagtgggtgcgggagtggaggaaggtatagacatccaggatgtaggatggctgtgtctgaattagacctcctcctacaaaaatagctcctcttccagatgttttttaaagtgagggaatacaaggtggtcatctgtaatctcttgagtcagaaagagaaagaggcaggcatagtgtcttgtgcctatagtccacctacttggcaggctgaggcaggagtatggattgagtccaggagtttggggctgcagtgtgctgtgactgcacctgtaaatagtcattgcattctagcctgagcaacacagtgagactccatctttaaaaaaaataaaaagagagtaaggattctcactgagacaccccccgaccccatctctgaaaaaagaatgaataaagagtaaggattcacactgactatttttcatatacttattgttgcatgtcgtgaattctctgaaagtaaaatgatctgaatatctacaggtaacctacaggtaatctatagcagacatcttactgtaggctatgtgtttggtttgattgtctatggtccacccttaatttaaattttttttttttttttttgagacggagcctcgctttgttgcccaggctggagtgcagtggcgcgatctcaggtcactgcaagctctgcctcctgggttcatgccattccctggcctcagcctcccgagtagctgggactacaggcacctgccaccacacctggctatttttttttttttttgtattttttagtagagacagggtttcaccatgttagccaggacagttttgatctcctgacattgtgatccacccacctcggcctcccaaagtgctgggattacaggtgggagccaacgcacccggccttaatttaaatttttaagaatatttgtcaaattttctggtatttgaattcaagcttacctctgatgaaacattaatatttctatttagttttccttgtcttgtttaaaaaattggaatttgttgtgtgcatttgattatgtatattttaaaactccaaattgcattttgaaatttggcagacaactgataactgtatttttctcaaatatataaaagatatattaacaatattagctttgctctgaggtctcgtaggtctgtagcctccttgagttgccttagtgaggcttccaaactgcaccgtgctccagtttttgaattaaactcttccatttttagaggccacctttactattctcctgaacatataaatgatgccttagtttactagtctcaagccctggcagagaatagatgtcaagtagatatttgatgagcagactctccctacttgatcagtgtttcttgaataaatgaataaattgttaatgataagtgcttattataattgtcaccacttttattccagtaatgtagccactgcctggcatctaatactattttttaaaaacagttaaaaaatatttttttttgtaactcacaaacttgatgttaattcgtatttaatgtttgtttttctatttaaaaaaatgcataaagttaaaattattgtacataaaagtttttacacagatttcacaaagctgaacacatgtgtctgtgcaattggttctgtactgcagcagctcaatgaacttgggagagacctgagtcctctcacgtaggactgagttgctctttatgggactgaacataagtgccataaaaccacttggtagggtttgttttggcatgttacagcatttcccctcgggaatgctcaaacattttatggatggaggatttccataaagtcttctacataaccttcaagtcatcttgtgtgaaaaagaacttagtttgcatttgttctgtagataattgttgatgttttataggtaacactctagatgtgtagaaagattgaggctttccaggcacttctcagacttactgactagtaagtctctgttattaaaaactagttttgttttttgttttttgagacggagtcttgctctgtcacccaggctggagtgcagtggcgtgatctcggctcactgcaacctccgcctcccgggttctagcggttctcctgcctcagcctcccaagtagctgggactacaggcaagtgccaccacgcccagctaatttttgtatttttagtagagacggggtttcaccatgttggccaggatggtcttgatctcttcaccttatgatccgcccgccttggcctcccaaagttctggaattacaggcgtgagccactgcgccctgcctaaaaactagttgtttttctcacaattctggaagcttggcagtcagaggtcaaggtgctggcaggtctggtgtctggtgacttgcagatggtggccttcttactgtattcttacatggggtggggttggaggggaaggtgagagaagagagggcgagagagagaagaagaagagaaagaggaggaggaggtggaggaagaagagagaagagagagaagcaagttcttctatgtctcattaagagcactaatgctattcaagagagccccaccatcatgatctcccaaaggtcccatctccaaatactgtcgcatcacattggggtttagggtttcagtgtatgaattttgggggacacaaacattcattttatggtacgtatcattcttttttaggttgggcagggaacaggctcctcatctctctctggcgttccccctattttccccaattccctaacaatttgaccaaagccatggccaacatcatcacttgacaaaatggaattgatttgttaaagcgcttgtttattttaagaatcaacctaaaggaaaaagaattcaagttacttattttggggtctggattgaaattttatttgctgtaattttatccccaaaatgacagattcctttttcatattttttgagtgggtatttgtgtcatttttttggcagcacttaagaaactatctcttattggtgattttgagaattgttcatacttgaacagagattatgagcttaagtttaaatagctttgaaatctttaaaaaatagttacatcttttaattgcatgaacactgtctatatttaacatgtccaactatttaaatgacctaatattttatatttgccaatgcaagcatagcaactgtcaggcaacaagtactttttttctgggccctacccagggatattaaaaaatagagtggagctgggcgtggtggctcaagcctgtaatcccagcattttgggaggccgaggcaggtggatcacctgaggtcaggagttcaagaccagtctggccaacattgcgaaaccctgactctactaaaaatacaaaaaaaaaaaaaaaaaaaaaaaagagtggaagacacagcaactgttctcatggaacttggcttctctccctgtctctctctttaaatacccaagggccaacttgtgccaatcatagttctgggtggaaatacaataataaatgaaatggataaaagtctctagggataaagcagtgaacaaaaaccacaaaaaattcctgtcctggtagagcttacattctacaggaatagaggcagaaaataaggaaataaataagaaatgtgcagtatgttaggcggtggtaagtgctatggagaaactaaagcgaggaaggggagaggaagtacaggggtgggtgggaggcagctggtacctttaactgtggttgtcatggatgactccactgtgaaggtatcacatgagcacctggaccagctaagggagagagccctgaggacctctgtgggaagagccctccaggcagaaatgcaaaagtgctgtgatggcctcatgcctggcttgccctccaagaaggcaggtagagcaagccagggggagtgtagtaaaaagtcaaagatgtacagggcaggctgtccaacatgcaaagccttagaggttatcacactatgttgattcttcccccactctcttccttccttctttgtgagttggggagccattagaaaattctgcactgaggaatgacctgattaaatgattttaaagatcactggttactgtgagaataaatataggaaggcaaggttggaaagagggagactaaataagaggctgttgtagcagtccaggtgttggcttagatctgggtggttgcagtggagatgctgaaaaagggcattctttgtctatttggaaagagtggaggagaggatctcagaaggataggatgtggagtataagtgagaaagcagtgtcaagcatgcttctaaggtttgggacctgataactggaagggtggggctgtcatttactgagatacaaagactgaagagtaacagatttggaagaggatcatgtcaggtgtgcacaccttagatttgagacacctattaggcttctaaatggagaaatggagtaggaggttgggaatatgaatattaattcaggggagacatctgggctgaagatgtaatgatgggagcttcatgatctcagtaaaagccataaaaggggagcaaatcctcgagagtgaggagatgagatcagtctgtcagagacagagtgaagacaatgaagttgcagttgtgtgctccattattatttgctgtaggtacagagagaagtaggaatttgtgggctagaaaactgaagcaactttcatgaaaagtgtgggacttggactggtccttgcaagtggttaggatttggagggttagagaaaatgaggagagggcattttggttaaaagttaccagaattaaacacagtgcaatatgaggtagtaagggaaaacacaccaaagtcatgatgggattttctcatgtgtggaagcggtaatacttgaagattttgttcagtctgtttccaaggatcatgatatgcaaatgataaagagacttgggtcccattaaattttttaacatttcccaatactttgctaacagcttttcctccttacccttgcagctggtgctgccttatattttgtagtaacttgaaactgacatgtggggaattttaagtacatatgttatcaaaacatgtttcacagactttatagactatcaggaggtcatcttgtctttcaaaaagcagcctggaatttgaatttagttcctcttataatttcatgctccaaagtaactatatgagaaatttaaaatttattagcaactttctcttgttcttagattttagagagatggcaatttcattaaacctgaaaaaaaaatatatatgctatgttacctagaggcagattattgaataactttacttgcctggtgataaatctaaggtgcatgagtattttaacgctttcccagcaactttggggttacatttttaaaaaggaaaaaaatcaacaaccctgcattcctttttgatacaaagtaacaaagcaaaaatgaacctcataaaagaatacaaaggatgccagcttcagaacaaatggttagagacattgtgccttttgtcccctctccccactttttcctagaatctatgtaagaatcaggtattgtttttattctgtcaaaggttttcatggagttgcaaaagctaaggactttggcagaactctctgaagtaagagcaaattatacatttcgttgttcattttccttaaagaatgcctttaaaataatgtggtgttaattgtttggcataaccaggtgtgacattccatatgcccatttgttctttgggtttcaaggaggttcagagtacaactcctgcaggacttgacagtttatctgtgtcccttgaatcctgcaggtgttggctggagagtagtaagcagttagtggcaaaggggtttataaagaaaccctgtggactctctagtgctgtccagtagaattttctatcctattcttggtgacaggaatattctatgtatgtactttccaatacgtgggtagatgctacccatactggctactgagtacttgaagtgtggttagtacagttgaggaacgaattttaagttgatttcattttaattaaatgcaagtagccacatgtagttagtgtctcctgtgcacttgtttttattctgtaaataaaatagtgactgcccagccaaagctaacaattcatcttgggctttctggagcacagagtggacagatgcccacactacccttgccggggcctttctgccatcctggtgagtgtccacaggcagatctttcacacagggacatggcacccctgcttatttccaggaactggacggtatacaggactttttgaaatgcctccctcttgtccttcccagaagtggggagaaggaataaggaaaagcagaatgacattagatgaggtgaggtcatttttatggtcttaaagacctttttctcacagagatattttaaaaaatagcctaggctgggtatggtggctcacgcctgtaatcccagcactttgggagaccgtacaggtggatcacttgaagccagaagttcgagaccaacttggccaacatggtgaaaccctgcgtctaataaaaatacaaaaattaaatgggtgtggtggtgcacacctgcaatcccagctactcgggaggctgaggcatgagaatcccttgaacctgggaggtggaggttgcattgagctgagatcatgccactgcactccagcctgggtgacagagtgagactccatctaaaaaaaaaaaaaaaaaaaaaaagaaagaaaacaagcctatttgagtattttattactgactgagaattatcctgggccgtagatgttagaggcagcattagtacatactgatcttgctggtgtcttgaaagtgagaattctgtgaagaaccaaatttcatacctggaggaagattgcgtgttcataaggaatattctctagattattattttaaaaatttaaaagtggattattgaaggtctaccatgcaccttcacgtaaatacaaaatgtgtatgtattgttccaggaagggggttattaaagaaaggcatagatagcacaggacataaaaatgatgaagattgggtcactgtaagccaaggaagggctgagtgtgtgacaaagacaggcgctgggccccaccccaggattctccagaaggatgttgctgttatggaagtcctggttaaaatcacactccgggagcatggtaggtggtgcaggataaaggaggtcttttgtctctcggtggtcagtttttacactgaagaagttggccacagtcttactgctgctgtggtgagctgcccctgccctgcgccagtatcagaagctgtcccagttgaatttgctgagaaaggtgtttaaaaagatttgttggttgatatttctgtggacattctgccactctcacttgtaaaactaaatggagcttatgtgccagggaccatgcttcacttgccatctaaatgaggaggaaaaaaatgtgtacatggaagaagaaaactaacgataaaaaatgctataaggtagatccccaatgagtggtgcagacagtaactgccatatccgatagttgtcttcaaatgcataaagggctggcaggtggaagaggtgttagacttactctctggggctccggaaggcaaaactggtggtatttctttttaattaaaaaaatgatttttgaaggcctatttatgtagagtactctggggagagagaatgatttaggagaggacagcatgttcaggatatggagatgtgacagtggctgcaagttacagggaagttcattccagtgaatagaagggagagcttcagaaaacacaacaggctgctgtgaggaggttatcccccttcatcggaggtgttcacaaagagaccttgcctactggctgggaaaggggattcatactggtagagcaggggtcagtcaaatctgggtggctacctccttttgtaaatgaagttttgttagaactcagccattgcccatttgtgtacgtatcctgcatggttggttttgcactacaatggtaaaagtgtgtaattgggacagagatcacttgtccctcaaagcctaaaatatttgttatctggccctttatagaaaaagtttgctgggccctacataggattggatttagagatatgtaaaatcctttttaattttctggttgtaagggattcagaaaagaagacaaaagccttgtgggaagtctgaagaaggtttcttgcaagatgtgaactttcggttgggccttaaaagaaaacgcttgctggtcctggcagaggaggcctgtccacatggaacacttgagcagatctcaagaggactgcatctctggtccttgaatgcagtgtacagactcattccagcatccatgcattcattcatgcattgtgactccagcatattgcaggccaatgtagtcatctacaaacacttcttggcctgctcttggtaaagtaagcacaaattctggcatgagctgttggcattttgttactaactttgccagagtgaaaatgctcgtgaagttcaatgtttatcattgagttttacagagttattttattttaagtataattgtctcacctagagacaacttagaatttatttatatattctgcttaattgtaggatgtaagaaatgatggttccaaaacgaaaacctcactgtatttgtaggagatgcaactcggagtgttaaggataggatgatgcacattactattcatgcctttttaattgattagcctttaaggcttctgcaagcctttaaaagttgttttgtcaacattagaccagctgctgtgtaattatggtagctcttcttgcagttaaattcctttaataacgtgttcaatctgccgatgccaaagtgctttgaacctgtgatatatactatggagagcttttgtttttacttacagatggtcggtgtcattttctgggcaactctagaattttcacagaaattttaaagatgaattacttgaaaatggaaggcaaatgaatttgaacatcaggttactcctccccctataaaatttgttcatatgtgacttgaattttgaacttggctcataacaacataaatgtgctcattaaaaaaaaaaattccaccttgaaacctttttaaggctcttttctctgactctccagcttgtaaattaaatcaaatctttctggcaccagagagatgatggtggaaacagtgggcctgtaacaaagatcacttgttaatgaggagccacaaaagggtggttctgccttccattcaggggctgaaacttcactcagaaaactgagtgtgaatttagcagtgtgtgaagtctggcatgagaacatataactagtgatagggtctggtgtcagaaagatacaaacagaagatcctgtgtttgtctcctcccagattcacctgtccttcctcccgcattgggttgtactggtggataaggcatgagaggtgggagcagtgatgatggtggctgtagaggctgcccctgttagttcaggccattttggtggcttccttcctatagccatttttttccctccaagatggagtcttgctctgtgacccaggctggagtgcagtgtcacgatctcagctcacggcaacttctgtctcctgagttgaagcaattctcctgcctcagcctcctgagtagctgggattacaggtgcatgccaccacacccggctaatttttgtatttttagtagagacggggttttaccatgttggccaggctggtctcaaactcctgacctcgtgatctgcccacctcagcctcccaaagtgctggcattacaggcatgaaccaccgcacctggcctcctatagcattttaaaaggcaaaccattcaaaacagaggcacagagcatcaacacatgaaggaataagagattagaccaagctacagcagctttctatggccccattatttaatttgtattaaggaatgcacctgtgttgttggaaaaccatgagacgagtccatcaaccacctgctcaccttttcttttcactgtacagcataagggggcttggaatgcaattaaccttatacattgtgaaaaagccgacatgcttcaagcttgaatagaagttcaagaatattaatgacctgcaaaatttgaagaagcagctaaccttggcgatattggcttacgtaatggtagggctagccaaaaattgtgcctcctgtactcactcacaatgtgcagatttgtttgccttgaaagctcgtgagccctgagaattggggcatttaagagtttgaggaaccatagacttatgagcatagagcacttgtggtgttatgaagtagccactagacactcaaatagagaaaactagaatttatttaattaaaagttgtttaattaattatatttttcctatgggataaaactgttcctggtaaatggcttaatcttttcaaagttacattaaatgttagtctggagtgtttttaatattgcaggctcatagagttgtgtatcaagatgtgcccaagagaactaccatcagtctcagcattatatttctaaataccaaaacttgctagtgtcagtagaagaatacatctttttggtaacatcaccttttgctaaaatgcatagtttacactgatatgattggaattaaatcagcctcagttgtcagttctaatcagctgcatgagacatggtcttcaattaatcttatctcataaacattagcattttaaatactttgtcagagtcttgcatacacttttcgaaaattagaaactttcagaacttctttgaggacttcaaaattgtttttgatacccttccaaaataatcttatgttatcttgagattgcattgaatcagagaggagatgttggctttaagacccgatagtcataaacctacatacatatatatgcacatatatccacatatatgagtaatcagctcccaaggaacctagtggtcagcaagacaagggacttgtgtatactcagatggccaaatgtcatggaggtctttatttctcaaactagtcatccccttaactctcctattacgttcaaaggtacccaggaataaaatctttttatttttcttatcaagtatgtagaatcttgtttgtaagcagcaaatacctggctcaaattaacttaggaacattaatctcatgtatgggccagaatgtgtctttctctttcacttgacttactctctgtggactctgtgaggattggcctttgcactctgggtctgtgtgcttgcctaacagtaaatttttatggcgatgaactgtgccacccctctgttatgttattaagtgtaaaataaattgaaagaagagttaaatagtcaaaatgctggaagaacagggcaatagcagggacttgagagcatttaatactcttttcccacttttttttttttttcctattaccttactgatttcattctttcttaatgcaaaacaagtatgcaaacaaggtgggagtgatgtcctcagatgctgctgaaatgtacacatctcatagtttatgccagcgtttaggactgactcatgctttctccagtaccagactcaacaatcctagggaagaaagctcattggcctatcttgggacagatatcaacatggaccaataagttttggcaggaggtaggaccacattgtacaaagttgtcattggtgaccccttttctatgtattagtaaaagaaaaatcactgtgggctggagaagcttcaaacacacgagatgttttccttccctacatggacacatcacctcagtcttcccaagtatggctactggcctcttctggatgtcttctttttccccattacctctagcctgagtgccatttcttttaatgatttggtaaagaacttggggcaagacatattgtagacaggaggagaatttctgggttggtgatttagagcagatctcttctgatcctttcccctgagcccagtacccctcatttactttttggcatgcaggaggaagtggcaactcaggagaaggcagatggaaaggttaaatggtgaagctcacaatctgcttggccaaggaaataatgcccttttcttaaaggctaaatgttttttcaggatgagtggatcagtggagtccaaatattcttgtctactgtaggagatatttgattctttatgtatgtataacatatgtgtaatagttgtagataaagcaattttgatttttctttgtttactgatttgttttcattatccaaattcacttgtatgtacttttaggctgagaaagttttccaaaccattttaacatgcaactcttcaaaaatttactgggattctttgtatttgcttaaataggagccattctgtgttttttccccaagttaatggtgctaactcacttaatgttctaattctgacagccattcagtaataatgcatttccagaggagttgcagtagaattttaagccttgtatttttggctcctacttagttatctaccctgattggcatttaaccattgaattagatttttcttctactgaagagagctttatgagctttaacttcaagtgtctgtgtcacagtgtgatttgtttgcattatgattgacactgagcaagcactttttgcaggaaaaggcattgtcttttaggattgagggaggatttggacacatagtctcctgacacttttttccagggttccatttaatagttgtgcacatcaataacaatctcacctggcacatgttaacatggttactttatttttgcaatcagtaatgatcatattccctgagagctgtttctctgggcctgttgactgatatggccataaatatatccccaaaggctaaaactgtacctgtttcagcacagatgaaataaaaataaatgtcccactgttttagtattacaaattataatctcactacagcatgaactttaaggtggtgatagttcaatttctgctctttgtttttgacatgatggtagaataaatacaattttaaaacattttattcaattaattttcagtgaccattttgtgtgcctggttcattctgtgctctctaaatcatgaaatacatttctttctttcttttctttgcttttttttttttttttttaagacagaacctcactctgttgcccaggctggagtgcagtggcacaatttcggctcatttcaacctccaccttccaggttcaagcgattcttctgcctcagcctcctgagtagctgggattacaagcgtgtgccaccatgcctggctaattcttggatttttagtagagatagggttttaccatgttgtccaggctggtcttgatctcctgacctcaggtgatccgcccgcttcggcctcccagagtgctgggattacaggcatgagccactgcgcccggctgaaatacattatatttcaaaaatagtactacctttagaagttcttacctttaattgttaatagtgaataaacaaaataatgttttctggacctataaatggattttgaagatatccttgccttaaagagaccaaataatatacttgctgtttcttcctattatattatcatattcattcactcagtcagcaaacatcgattactctacctctgggaacctaaaacatactagggacgtatagacaagtaacaagtctttaataaagagttagagaaatcatgacgtaaagtacaatggggacacaaagatagggactggctggttgcattcagggattgctttaactagaagataacacttgaagtaagccacttatgctaactgggtgtgcccagagagggccagaaagaaggccaaaagaatgtgaatcaagtcctagagcataaagcggcatgggcaattgggggaagttgtttgtttaaatttagagtcaatgtgtaagggagtgagtatctagaagtgggacacaaaaaaggtgggatagaccctaatcagagatgaatatgcaaatatatatattttctaaatatatatatatatttgactagaatttgaattttattctagatattagtagttttccaacgtttttggtttacagtattaaatttaagaggaggatgaatattcctgtgattgtcaacttggggaagtaccagaatcttgttgggtggaggacaggggcacattaataattttaaaaacccacaaggtgattgtgataagtccttgtgtcctctccattgagaattattgctatgggcagtggaaaccactgagttttaagtggagtccttaatatcagtgaccccattaaagtactatctcaatttattattctttaaataaaacaattgaaaaatatacttacgtcctccatctctatgctcccatgatcctctatgtaatttttcagtatcaaattttaaaaaaactcatttgttgtgctgttggcacaaacatattttaaaggagtgtttgggaatggaacataaaacagaaatggaaaaaaaattaacattatatatgtctgtctttgatttccatgactgcacatctttgatttccatgcatgtctttgattttcatgactcagagcttttctgagattcctatgggggtgtccaggctaatgggagaagcagctggaggagagtatggcaggccgagtgcctggcacacagtaggcacacaatgattgctagtgtctttagcttctccttttaaacttcagctctttagttgaaatttaggagccactggattttctgttagtggctaatgtcaagagtggctgagaaaaatgtttgaaactgaggagaaaatagtgtctcagatattagacacatataaacattagaagggaatttaatgattgtctcgtatcccagccttctgcttcacagttggtgaaaccaaggccctgacttgacatcacttgagtgacttgacatcacaaggctattaaattacagaaaaggaccagaagccaggtcctttaattccttcatgtctctcagacatgtagatggcatttcttcctgttttttctttttcttagagttaactccatgaaaggttctaatcagcatatctaaaacatagcccttcatgaacttcttcctctttctctactttttgtatccctctattactagaaagggatcccaatccagaccccaagagagggttcctggacctcgtgcaggaaagaatttgtggtaagttcatattgtaaagtgaaagtaagtttattaaggaagaaaataaacaaaagaatggctgttccataggcagagcagcggcatgggctgctcacctgagtatacttacagttacttcttgattatatgctaaacaagaggtggattattcatgagttttctgggaaagaggtaggcaattcctggaactgagagttcctgcccattttagaccatataaagtaacttcctgatgttgctatggcatttgtaaactgtcatggtgctgttggaagtgtcttttagcatgctaatacattataattagtgtataatgagcagtgaggacgactggaggtcacttttgtcaccatcttggctttggtgggttttggctagcttctttaccacaacttgtttatcagcaggggctttgtgacctgtattttgtaccagcctcctatctcatcctgtgactaagaatgccttaatctcctgggaatgcagctcagtaggtctcagccttatttttcccagcccctattcaagatggagttgctgtggttcaaatgcctctgacacctcagtggcatcaacatctaccatgcacttgagctagtcatttcagcatcaattttgtctccatcttatacagtattcagctagtcatcgagtcctgttggtatcactttggaaatgtctctcacatctatctttgcttctatttcctatattacttccttaatttagtctttacttgtttttttttttttccctctggactattgaagtagcttttaaattgggttctgccttctgcagtccactgtctccactgcctctggagttttctttttgaaatataaatctcaatgatgggttcagtagccttcagtggcctttcattctattgaaaagtccttttctctagctgtagcctttcacaatatagctttgatgtcccttttcaacattttcttctgatcatttttctactccctttatctgccagactctgatcacaccagcccattcaatgttcctaatttttcaatgtactttcctgggacacccttcatcacctcagtttgagcacacatcagtgctcaattctatgcatgcgtaggaaaagaaaagttgttttcctctgttctttatagttcttagttggggtggacccctgtaacaaaagacagattaagatgagaaaaacaagtttattaacatgtatatttcaaatatacatgggagatacccagataaatgagtaaatctcgaaagggtagatttgaattcaggcttaaatatcatcttcagctagaacaaagaaagctgttgggggatacagttatgggaggtaaccaggaaaagcgtgagacacaagggtaagattccttatatagatttaagtcagtgccttctccattaatacaagtctctagtgatttagagtcatctttcctgatgcagagagggtgacacagttacaaatagagatttcctttatagatgtaaattttcctacaaaagggtaacttctactctgcttttagagcttctcctgtattttcagtgttcaaaataatcagcttgaaataatctttatgccaaagaggcatactttgggatggcgtattctggtctcttaaatacacatcactttctttgagtcctcctttcctttcttggtcgagataaacagatggatcctctgttacccacagagcactttgtttcttctctaaccatactgagtgctgtagtctgatgtgcatgagaattaattttctttttgaatatgtctgttttattcaatagtttatgaagtccttgagctcagcagttgtatcaaattcatttttatatccttggtacctgtggtaaattgaataatggtcccctgtagatttgcatcttctaatccttggaacctgtcagtatgttaccttacatggtaaaagggatttcttagatgtggttaattaaggatcctgagatggggctattatcttattatcatggtggagaaaggcaggagggttggggcagagaagatgatgtgatgagagaagcaggcatagagaggggatagtcagaagaagcagaggttgcaatgatgtgctttgaaggtaaaggaaggcaccatgagccaaggagtgcatgtagcctctggaaaaggcaaggaagctcattctcccttagagcctccataaggaatgaaactgtgcagatgcttgattttagcccagtaagacccatattggacttctgaccttcagaactttgagataacacatttgtgtaagtttcgagctactaattttgtggtaatttgttacagcagcaataggaaactaatacagtggaggagaggaaaaatatttttttctctacccattgtaggtttatggatgaggcctctatgacaaaaaacagattaacaagagaaaagcatacaaatttatttaataaatttttatgtgacatgggagccttcataaggaaattgagacccacagaaatgggtaaacctgagtatttttaggctaggtttgataacgagtggatagttgtggagaaatatgatgggataaaaagggtataatgtaataggaataaattgaggagaacttagaaaggtctgtttgttcagattctgcccatgactgtcttaatccattttgtgctgctacaacagaatggctgagactaggcaacttataaacaatataagtttacttgtttcatggttccagagtctgagaagttaaatatcaaggatctggcatctgctgggggcctttttgctacatcatcccatggcagaaggtagaagggaaggagagtgcatatgagagggtgagaagtgaagggggctagaactcattattttcttaggaacgtactcttatgataaataacccactcccaagataatgacattaatccattccgagtcacctcttaaagatcccacctctcaacactgttgcatgggagattaagttttcaacacgtgcaatttgggggatactttcaactcaaaacagtggcgcttcatctttagcgacaaggatgttccttttgtcctggtatagggaagcacctcttagatgagggtcaatgatctgcttcaagggaaagttagaaagtccttcttaagttttttgaccagcttcagcggagaagtatgggggcaggtcagagagaccgtcctgctactgaaggaatttttctcacattcctttagccttaaagtttcactatgccaaggtgccatattttgggttagtatgttctgaaccccatcaacagcacttacatgtaacatgcagttgggcttagtgtatttgcatctgaccttgactaatcaagagaattgttctcgatgcccatgatgatcaaagctaacatttattgaaccttttgctgtgtgccagtcactgtggtcaacatttatacttgatcttcataatcactgtatggcaccattattatccctatttggcagatgagaaaactgatgcacaaagtgttttaataattttcccccaatcacactacccaatatgtgatggcactgggacttggaagtgagcagtctggctcccaggtctgtggccacagcgctgtatcctgcttagtcatgttctcatgtcacatatatgcaatttatgtgtgctgtcctagtgtgatatgtcgtgaagaaaattggaagagctagatttgaatattgatgccttcagtaatcagttggctctgtaaatgtgggcaagtcagctaacctagatctgtgtgcctgtctttgttaaatcattccttttctgcttaccttatggggttaatatgaagactgaatgataaatcacatgggaaagtgctttgagaaacagcaggcactacacatatgctatttataagtatatatttggttgatgtagatcttttgcagatttcctcataccaggattacctggctggtctgattcatttggtgagtaggggcttaataatatttggtaaatgcatttgataaaaatgctcttttgccctcctagttctcattcttatattttgggttgttgacactaaaaatctgaaagctcagaatttagtctccttcatagaactttattttctttcctacttttaaaaaaatgagcctttcttatctcactccttagctagtatttttatcttgtagcccataggaaggtacgacttatagaagatttgcaatgatttcagcagcttttcagaagggctttgagtgaacagttaatctcttgagaatgcaaagtcatttgtggtggagaatcttaggccagtgttgagttgcaaatcctggggagtcctgactcaagaagatagggaatttaaaaagaaagccagtgaaatacatttgattctctttttccctgtcctgccttagcctgcaatgttacttattcctttaagatgctttaattgctaattgtctgctgtttgattttgaggttagttgaaatcaccaggatgatggaaggcctgacctgaccagacctgaattcattggcaaattctcaactttttgaaaaattaatgagttttggctgagatgacacctgactttttacagcatcttgttttgatttattgtttcttttgtttacttgtcagatattcccgcccatgacatggatttacagagtacaatttttttttttttttttgcatgttcaaagtcaagctatcctgattggtgcaacatacagacataaaatgatactttgaggggcatccttttggatacatttttgttcctctctcattgtttccctgggatgaattcttagacatagaattactccaggaagggtaccaacttaaaacattaaaatcaaaccaaacaagaaaaagatacatattaatagattgtattccctaaaggctgtactaattaacactcccaccagtagtgtatgagaatgcatatctcacggcaactttgtcattgttcacttactctgtagcatctctggagtactcacaatcttctaggttcagacatttttcagaagttttcaaaatcaccccaggtgatttgaagctgaaaccactggtttagttgataggagaaaagcattctctcactatctcttagtggtttgaatctctctcactatccccttaaaatagatcagtcactttaggtcattggtgtgttttgctacacaggacatactattcctaatgaacagccccttcatcactctaacactcttgaaccactaattcacagtagtgtcacttctaggcttattaatataatcttttgcccatgcaaagctctccaatgttcagataattctgctggatgatgttacctttcaactgaaccacatcatcttgttggcaaagcacctcatgaatactatctcatttaactattgcagggaccttggaattagacatttccattctatttttacagagaaaggaaaaggaacccaaataagtagcttttctctaaggttgtgcaacttataatcacatgttaggaactgaatcaatgtaggtcttctgatttcaagttcagagtttccagtgttgtgtcagaacctgtctttggctttcgctagttctgctgcttttttaatgcacaaatggatctggttattggattgttattaaggatttttttttcagtgtctgcatttcttacgcttattttcttctctgtgtgctcatttagaattctacatatttacagctgtgtttctcaacgtttatttttattattgctcctccttccctaggaaaaaaatttaatttaatttacattcttcctaatgagaaaaattaaatattaaactgataagaacagctactacacttgatcttagccaaaaggctgagaagtgaagagaaattaaatattaaggaataaaattttgacaggtagggttgagccttggaggaccacaaactatgatatctgatgtttttgttcctcaacaaccaattttaatcttgggagttcaaaaatgctgttaatggacacaccaatttagatgactaaccctggctatcagggcagagaggagagctgttgaacattctgatagatcttataaccgtatgtgtgcaactagtggaacacatgacaccgacattactctcagctcacatcaactaatgacttacaaggaagctgtgcttcagtgtgggtggctaattattcaaacttgcattctgtatgattaaaccacatggaatttcacatttgcttttgttttccatatattttatgggtcatatagattatatctccacctttcacccactgcctgccttttttattaaatgtgagctttgtataaggcttttgtctactttttgtcatagctctgggctgaacttttagattcattagtctctgatttgtggcagttacctacatttttacttacaattttagataaataaatgccggcgtgttcacaggcaggaaaacactgcattggtagataagggccattccatgctgggcttgactggttgccaccaactctgacatccctgaccccttggcagagaaagaatgtaaatgagcgagaataaagagccccaggtagcttctgtttgtttttacaagagaaccagagctaggtgatttgggagaatgccagatattataaacacagagccagagaaaaagaacaaggatggcaagaagagtccagggactgggggaggtgcacttgcagggggtggaggttggcccagaggaaggttttcattcatttctgtgtgtagaatttttaagattaacttgctaatttttttattgaagtcaagcaagattttaaatcatttatcagggctcatagagtacctatttatagaagtcagaataaaagtaaatgaaccatgaatgctaacacacatctagcaaatttagtaagatttaaaagttaaataaaccaatggagcctgcagattttctccagggcccctttacaagttttaactttgtttccattcccccccacttcattttacacactgtcatgtgtgattcttttagccttagcttttagaatacgaaaatgatttacaagcctgtttttagaggctatttcatttttagttaaacgtttacatgatgctggcttcctatgtaactgctgaaaaacaaaagttttttttttcttttttacaggtgctagactgtcaatcaggataaaggagattgtatgaattatttgttgttgcataacaaattgccacaagtaaaacaacaaacatttattatctcaaattttgtatggcttaggtgggtcctgtgcttcagggtctattacaaggctgcaatcggttgttagccaggacagggatctcatctgaaagctcaaccgggaaagatccacttccatgctcccatggttgccgcataatccagtttgttgagggcttttggactgagggcctcagttcctaactgctttggaggccaccttcagttcctggttatgtgggccttctcaacattggaacttgcctcctcaaagccagcaagagatagtctgctggaaagacatccaccatctttgctatattctgttggttagagagtcactagaacagccgacactaaagggcaggagattacacaagcgcattaacaccagatcgaggggcaccttaggatcctaggccaaggagatatgtgactccatcccaacaagccttcaggatcttagattctttgagggaagagacctttttttcgtagttaaaatatttacaaaacctttgtgaggtcatagctagcgctttgtgctgaactggattgtggagccctgggctagcactgtgcagggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtgtgttagagggaaaggaatatattctggttctggagattttcagttttctttttatctcattaattcctggctgggtgttccaggacaaggtatccaaaaagccttttttgaatcgcaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcaggtgggtgagtattagacatcactcaaggaaggcttcctggaagaggtgacacagagttgaattagttggacttaacctttgaagaaatgaaggcaggctttgctgggaggcattggagtattaggtataaaggtttagaagcaggagagcatttgggacctcacaaaactgcaagttgttcagtatggatggagtttaggggacttcttggaaagtagtaaaaattgaggctggagctgggtgtggtgatgcctgaaatcccagctattcaggaggctgaggcatgaggatcacttgagcccagcagtcagaggcttcagtgatctatgattgcaccactgcactccagcctgggtgacagagtgagaccctgtctctacaaataaaaaataaaaagatgagactggcaaggtaggcaggaataaaatgatcatcagagttcttggatgttgttccagggattttggactttaccttaaaggaatcaagggataatccaatcagattgtgctttagaagtagagaaggattggaggggtgttaggcgacaagaagaccaaatagtatgtaggtgaagggagagggggtctaaaatacagtgaagtcagaggaagaggagataatgaatttgagatcctaaagatgcagaatcatcaagacagggtgatggcactggttgtggagcgggaaacagaggaagaagggaagcttgacttagatttctgactttagtgactgggtagatggtggggtgactcgccagtctacaaaatattgggaaagtgatacgtttgagtttagttttggaattattaattataggagtttgtaggaatctgagcagagatgagcagtgtttcagggtgtccagatctggagctcaggtgaatgtggaggagaccaccaggggagagtatgcggacccagaggagaaatagggtgaagggtgagtgcctgtgacatctgcagttagaggggagaggacactgtaagagaggaggagaaatgagtggtatgataatcaaggttcccggggttacaggccacgggagccaacacaagctagctcaagcaaaaacacactttttagaatttaggttatcaaaggcactcaaggttctggaactaggacccaaaaagtctccaggagcacagcaggcactctgtcacactaaggtcctcatattgcagcaaggctgttccctttttctgtctaaaaaccatcttcctccattgctctgtgtgggtgacatacccacagctcctgagttgaagcctcctcagataatgagatctcccatccaattgactgcctttcgacctcaactccagttttctgggagacttagtctagcgtttcatcttggaaaggtgcccatggtgtcatgcaatacaaatgtggctaatgagggcccaccctggctgtagtcagcccttagagaaagaaggatgtagttagaatcgtatctaccatgggcagctgaaatgataggaagacagtggcaggaagaggggtcaaaaaagccagacaaagggagagattcaaagaggagggaggaagtggtccactgtgctagatgccgctgacccaacagaaggattgaattcaggaagaaaaggactgtgagtccatgactttgagtagctaagtttgtgaaaagaagtgggaaattgttggttttcatttagacgggtaaggcataagtatgcttctctgtgggggaagaggaggaacaggcattaaagtgggagggtagacaatacagctgaaggagggcataactgatggttgagattcccgagaaatcaagagggaacagaggtggagcgattagcagcagacgggaacgggccacggctctcaccaaggctggcaggaaagtggggtgcagatgtagataatttggagggtgagctgctaagaaattaagtccagattctggtgacaggaattatttactctttataaaaccctaagttcttcttttgctccttaaatgtactgaataaatgctgagaagagcaatttaaaggtctttgacaactgaagaatctggtattacatatgccaggggattgacacagagagcttatgccaggccaggactccttataggagccccaagttgggcccagtgtccctgtctgaagtaaatgctcctgtgttcctgctgtggtctgtgttcctccagaatccatatgttggaacttaatttccagtgtgatagtattaagaggtggagcctttaggaggtgatttactcatgagggtggagccctcatgagtgggattaatgaccttatataagaggcgtgagggtgctgttcatccctgtttccctcccatctcttttaccttgtgagggtgagcaacaaggcactattttggaagcagagaacagccctcaccagacacggaatctgctggtgccctgatcttggaattcccaccgtctagaactgtgagtagtacacttctcttgcttataaataaattacccggtctgtggtatattgttatagcagaacaaacagactcggacaattcctaagtaagttcaagaacatcccatgagaagcaaacataaaaatatgaatgtgtcactccagcctgggcaacagtgagaccctgtccctacaaaaaataaaaaaatgttagctgggcatggtggtgtgcacctgtagtccctgctactcaggagggtgaagcaggataattgcttgagcctaggacttcgaagttacgtaagtgagctatgattgctccactgtactcctgcctagacaacagagtaagaccctgtctcttaaaaataatgaacgtagctaatgacaactgtacaagaattagaaagctttgaggttgtctttctcctgtcttcttgctatggctttcctctcctcactgaggctgactctttttataagtgagaggatcccactctgttgcccaggttgaagagcagggggcgagaccatggctcactgcagccttgacctctcagtctcaggtgattcttggttgcatgaacagtatagggctgggatcctgtgcaagatggccttgctcccaagtttgtcagctgtcattggcaaagcacgtatctaaggatgtctggcccaaaatggactcatcctctcacccaccactccatttaccagaagacctggaaggttttcttccatgcatctttagcaaggctaagtgagaattactagcatgggattcaagagaaacttaggtttagtaaaaaagagaaagtggacgtatatatcattaaatattctaaagcagtattttttcctctaagaaatcttctggtttagtttaccaaaaagaggatgggatgatggtgatgttacccaagttaatttatgtttcaaatggaagaagcaagcaggttttttgtgtgtgtgtatttaggaagcagaaaccatgatttgtgggaattctttcatggtaatagtcaccagcattttttgagtgcctcacacgtgcctggaatcgtgtcgtcagaacccgtgcctggcacttagcaggcgtcaggaggcacaggtctgctgatgcacttaactagtgtttgtgctaccagaggatgcagagggcagactttccagtaagaaatgggatgagctgtgagagtagcttcgtcaaatctgccatactttgctggagtgtccatagtactcctatttaatcctgattttaggcctagaaattctctgcttgatctgagggaggggtattggaccatcgagggagcaaaaacaagtccttaagcccttccacctgcccctccacagaggcttccaaaattccaaacccaggggagatggctctttgaccttcaggtggcacaataacttataggagagcggaggcattccagggatttgctgccctgggatatttatttgaataggtccttattctggacagaaagacaaaattaaggactatggcttgaaaatagagatttgtcagccttcttcctgggtgaatagaatgttcagtgggtgcaggtgaggctttatcagacttcaagctgccgcagcacagcccatcctcattaattcctaatacttgcgatacaactctatcagtaagaccttacgcctgataaagtcccgttcctctcttaagactataaccgtatactttgcttatgctattgtacttttgtcactttgaattccctgtttgaatttaaagactggtctctttgactaaatttccctagcagaatatccagattggttcaaagcccatgagtagaggcagtagttcctcttaaatactgttgtcttaaatactgagggacaattcacaaggacaccttcatctggggtgttgggtgcatttcattctcacttttaaattaacaaactattttgggaattgagacatttgacattagatgactccaggatttcactgtcttaaagctggtctaaacttgcagagcattcaaagaatttggtttagtttaaaaaattattgatctctatgagccaatgtatataatggtcaagaaaagacaatataaattcattgtaataaaggctaggatagtagattcctgtgaagagggtggggatgggacaggggcataagctttctagaatgctggaagtgtttataacttgtttcaggtgttgagttacacaggagcatacaaatgtaaaaattcacagagctttatttacagcagtgaaaaagaatacaaaaattttcatctaggggttgatcccatcattccctaagattgcaggcttcattacaggtcctcagtgtaaacctttctggagttttaagatcctttagggagttacaggatcagatttgtgctttgagtagctctctctggttgttgctagagaaagggttggaggggactaagtgagagcagtggccatggctgggaggctgatgctgtggtcagcaagagagagcaggcccttgattagagggcaggcaaggggctttgtggggtgcaggagaaggtgttgagggtgactcccaggagtcctataggagcagttgtgtggagggaagggccagtgcctggagatcaagaattcagctgcaggcaagtttagtttctaatgccagtgagccaccgttgaagatgacaagtaggtaattaagtagatgagtctggagtcagaaaatcagtctgagctgaagttataaatttgggagttgctggcatggtatttaaagcaatgagaatgcatgaaatcactttgggagagagcatagagtaggaaggaaaggggttccaggactgtgtcctgagaaattgccacatttagaggtcaggtaggggaggagtcagaataggaggctgaaaagggatgaaaggggagtacaaggacagcaaggagaccgagctgtcctcgtgtccaagggaagaatattacaagaagtggagagtggtgaactgtggtgagtgttgttgaggagtcaagtaagtggaggactgaaatcctcacttggatttcatagcatggaggccattggtcatctcagcaagattggcttatttggaggtgtgctggtagaagccacacggtagtgaaacaaagctgtatgtgtttttcttgcaggttatttgttgctttagtcatgtattcaaaatatcaatccttcatgtaacatttaattgtataagcttaattctattatgtaatgtaaagagattaattggaatctagtttctttagctattttagtgaaagacattgaagatagaaagttgctgtgggaaactatttttgtggctttatatttactcagttggatttttaaagaggtcattttatggtccattcctgcccccatgcaggaatgaactgcatgataattgattcatattgctttaaagggcaaagtattgagggaacttcttgggaaatttagattttgtctagctgatcctgaggctaagtatccttggaggctaaatggccagcatcttttcttaaacttatggaaatctcaataatggaaagaaaccagggcagggaaggctcacatcactttatttcagaagtcaagcatatggttttgttgactaaaatacatagactgagaaaaaagaaaaacaaaggaaaaaagtctcaattatgttcaggtctggagtttaggaagtgttttgtgaatacgatgcatcttatggctttgtatttgatgtcaactcaatgtttagtcgaggttgaaaagtagagtagatgtgtgactttcctacttcctgtgacacagtgacatctagccctggatcctggtgctccatgatattgggaatgaaggcaacaatttgagtattatctagatagagcccagcaagtagtaggtgcccgagtgatattgtgttgaataaagttacactgaagggaagtctgtccctgacaatctcccttctcttgtttgctgagtcttaggctcttaagagaaatgatctatattaattttctccttattcttgcatttaggaggttctcctgagaatcggaaagtccagtctatagtaagtttccctctgctggtgtcaacagggagggttaacatcctgcttcacaggaaggtagcacatgttaggcttttactatacatggttaatattttcaggatgaaatttgattttacagcatagtcatatttatgcaatatgatattataatacaattatgaggaaaaatagtggttttgttttgttttgcatgcaaggaaatgtgctgggatgaccaggaaagaaagcagtgaaggaaacaacttcactcccactatttgtggagcttgtttggttctggcaggaagtcagggtttcagaggagatgggatgttcagtttggtccaggtgatcttcagtcttcaaggatctagagagacttgggggttgtccatgattcatcagaagagctgtttcacagacctcagggtttgttaagggttagaatcacagtgccttcgtaaatttttcttagatggaggtgaaggtatgagtagatttattctgaaggtagacaaaccaggatttaccttgatttcttgagtatttttcatcagcgtaaatgaacccaataagtaagtgcccgtgggtggcactgtgatttttgatatacagttggtatcaaactaattgtaatgggtcttggcgagatgaagtcatggactgtgggaggtaggtggggtgtgagtggggaacacttgagtgagaggtttcttttcctctgaaggaatgatgatgatgataatcatgcctactgtttattgaatgggcactgatgtggtcctgccctctgtattggcatgacgaaaataaagctcagcaagttcttatgtgttctttgaccctgaaatcccagtggtctaaaaatagatttagaaaatacctttcctaaagagaatcagaaaaatgtttggggttctcccaacattttctctttgtatattcttgtttctctgtttattctaccatgcttttttgtgggcccattgctataactgttaccatgacatttgaaattcccaagtgctataaagagacagtgttgttattattgctgtttgttattttttattattgctgtgattgcagggaggcaaggaactgggtttgacaggtggaagggggaattccaacaagagtacgtctgggatgatgggaagctgaggactgggatactgagagagttagacaggatgtgactaacgagaacaatgccatcaatatgcaaagcatacagaattgcgaatctgattccaaaaatgctaccactgcaaaattacaatagcagcgttttcttagtgcataagccaagtgttattttagcctgagagaaggcagctgaactggagatagtgaacgcacctaaacaaatgtggcctgggatgaagctgcaaaaacacaaaagggctgcatgctggcatggaaaccgcctcagagctgaaacaacagaagctgaagttgagcagtgtcagcccgggatgtgtggtttgccctgggtctgttttggaggccttgggaaaacagccctacagataaattctccagatttgcggtctaaaactggtacaaaagaaacagctctgtctaacttggcaagattgaagagctttctggtggttaacttgcactgtgcatatctatttgtatgccctgcatttcatctgaatactattaaaataaatggaattagaagtccctcacccacgccattctgagcccagaacattttttttttccattgccttcttaactctgctcagtaggggggtcttcctagtttggaaaaaccactgcttggatgttctagaggaggggataaagaacaaggtcagataaacctaatctcctaatctcccatctgtaaaatactactaataataactacttcatagggttgttgtgagaattaaatgcaattaataatattgcaatttaatataaaattcattatcattagatgccatacatgtgtagaagatctaataaaaatatattactgggtactcattgtgtcttacccactgtttcactgtctttatatacaatttcttatctgggataagcaacttaatccagggacgcatgtaaagcttataaagtgtagaaagatttgaaatcctcagaactgctggtaaagctcacatgtaaccattgctactgttccctaatttggaatctggcattttgtaggtgcagtactgactaaattcatttaattaaatatggagcaatccaaagctcccatgttcttttctcctggttttatataaactgtctacagtgcagtcaccaaacctttgcatctcctttgtcactgggatcaggagatagcataaaatcagacttctgctgtatatggttatacatatatgagccatctcactatagggctccactgtcttaaccagggtctggactattgctgctaagaaaactgatgacccctggtttagaactttgtctaacaacaaatgactttgaataggcaagtggttttttgtggtgaagtagatgactcttttctttcttttttccttttttttttttcttggaaacatgcggagtgatgttgtctgtcaggtctgctggcaggttctgttgcaaggagactatgcaggaatctgcctgcttggcttaatcactggaaaaaaaaaaacacaactgccaagcaagtcccaggttgaagtgggcaccgcacacaggagctgctttatcagacttaaagggatgctgcgagaggcaggagcacttctcccagatgtaggctctaaccttgaaggaacagtggctctcacaggcccggtaataatgtgagcataaaaaagcaaagtggctgggtgcggtggctcatacctgtaatcccagtatttgggaggccaaggtgggtgaatcacctgaggtcaggagtttgagaccagcctgggcaacacggtgaaaccccgcctctactacaaatacaaaagttagcccggtgtggtggcacacacctatagttccagctactcgggaggctgagacaggagaattgcttgattctgggaggcggaggttgcagtgagctgagatcacaccactgcactccagcctggacgacagagcgagactttgtccccacccccccccccacccccccaaaaaagcaagggaaactgttagggcacctctgatccttccagtgtctgtatctgtgtttgctggctttatcattactcttgccctggagcctcctgcaggcctcatgtgtattcatcgcaaatataccatctccaatgtgcctggcatgaggtcaggccctggggatccagtaatgagacatagttcctatctatatattgtctcttcctttttctatgcaccccctaaagctggagatgctgttttacctattcttcaaaagactttcctagctatgtgtaactcatagtaataatcaagggagtatctatgattaataatatatatattttgagacagggtttcactctgtcacccaggctggaatgtagtagcacaatcacagctccttgcagcctcaaccttccctggcttaggtgatcctcccacctcagcctcctgagtagctaggattacaggtgcctgccaccacgcccagctaatttttgtattttttatagagacagaatttcgccatgttgcccaggctggtttcgaactccttggctcaagctgtccacctgccctggcctcccaaagtgctaggattacaggcatgagacattgggcttggcccgattaaactttttaagaggacttgtcccatcatttcatgttaattctcctgtttttaagtagtcagtttagtagcaatattttaacttattctaatactcattaatttattaacaaatatttttggatgtctcttatctgtaaggtgctatgtggttcatgtttttgatgagtgattattttcgtttgtacagatcgtttaaatgagagtttgcagaagatgaaaggggagtcttgcattcagcaatttgccctgtatttaatgagccagccaccttgtgtcttcccctcctatgacatagcccttcagctcaccctacaattgccacatgaaaacttctctcatgaaacccacagggtcagtatctctcaaatactctttttcctccacttctggggcatgatcttgcaatgtactccttactgccccatcctggaaacttgtgcctatatccttgttttctatacagtgtttagccaaggtccttgaccggaatatagatcacaaaaagtactggttgtcaaatgtcaaagtaactgacatttaacagagagattatatttgaggatgccaagaattagcaaacatttttttctgatcatctcaggctatttgaagaagttatgaattcaccgaattgactgaaacctgccctctgaataattcttcagcactatataaaccaaagtttgtgttggttcaagcaggcaggagggctgtgcatctgtggtatgggagccccctcaactagaggctagaaaaaaacagcatttatgctgcagctggttttggtatcagatgagcagctttaaattgggagttaggagaactggaagacttgagtccaagaggaaggtagttgaagcagagatggctcagaaaccactaggatctgtgcatcaacacctgcctcaggtctttatggacataactgctaaacctttggaagcctgaggtttacaaaccacttaccttaaatgtttacgcttaaattttaagaaaaaaattttaaaagtttaccaaaggatgctcaattcctggaatagaatagaccttcattttacaattgatatttggaaaaaattctgggttagttcctattagattcaatgaaaatcagcagtggaagaatttattctcatgatcgtgattgaacttaccttgggtgggtgcttcagttctgtgtctttgtgtcaggaaaggctgtgggctggaaagagccctgagctcagctgtgtctcatgtcagccatgctccttcagaaccacagaataaggcaaggactagacatctgaaatcattcacagctaatagctgtaattccatcatttagttcattaattcaacaaatgtttatcaagcatcacctactaagtgccaggcatcttcctaagtgctagtttacagcagtgaacaaacagaatccctacccttgagaagcttcaatctgcagcatgggtgaaactgacagtgagcaagataaatcagtaaacaacagtagatatcagaaggtgagagagaagtactgtagagaactccctcgaaacagagcagaggaacgggaaggatttgcagttttcgataaggaaagcttccctgagaaggtgaccttgaataaaaactagatggaggtaaggaggcaaatgccacaggtatctgggggaatcttcctgacagaggaaagagcacatgcagatgccctgaggcaggagctagttggcaagtgtgagaaatagcaagcggtggaatgatcctgaataggagataaggtcagaaatggggagcgggggcagctcttgattatatagtgtcttgaaggactttgttatacctctggattttactgagtgaggaagaaagccacaggggcgttctaagcagagcgaagataagacataacttatcttttaaaagaatcactctacatgacatgctaagaagaggctatagaggcaaagcagggagcccaggtgggaggcttatgcgacattccagacaagaattgatggaggtggtaaaggggcgatccatttgaaaggtttgcatatggtaagttgtgagtgtgggacaaagtgtagagtcaaggatagtccaagcattttggcctgaacagctagaaacatgggagtggccattaactcaggcagggtactctgtgaccatagcagatgtttggagactgaccagttattctgttttggacattgaaagttttataagggcatgagacctccaggagaaaacgttgggtaaacagttggatacagaagtatgcaactcaatgaagacatctgggataaaaatatatagttgagagacatgagcatacggatggtatttaaagccatcagcctggatgagcacaccaaggtatgagtgagaaagaagttattgaatgaagggtttaaggactgacctttggggtactcaattttgagtctgggacacagggaaatagcaaaggaaggtgagaaaaagcaaccattaaaagagaaggaaagccaacccagagaagagtcccagaagccaactgaagaagaggatatgaagaagatgtgatctgctgggtcaaatgctgtaaataagatgacaactgagaactgagcagtatattgagcaccgtggacatcattggtggccttgaggagaattgtttgggtggtgtggtggggcagatggtttttggagggagttgacaacaaaatggaagaagaggaactggagacaagtgtaaagactcttgaagagttttactgcaaaaggaagagaagaatagtctggtaccttataggggaacttcagtcaggaggattctgttttgttgtttggtttggtttttgcctttagaggggtgaaacaacagtatgaaggtttattgctggtactgatgtagtagagagcaaaaagttaagatacggaggggagaattgctattgggttgctgagtagggaggaagagatggggtctgttgacgaggtggccctgttttaggaatatagttcatcctctgtaacaggaggtaggcagagtgtatgggcaagattctcacaggtagagagaggtggtggtgagaccatgtgccagttcttttctgattgcttcagattttttagtgaagtcagaaaacaggtcaccaacaaagagtgatgcttgggtagaaaatgatagaaatttgaagatagagaaggaagatagaacattgtcatcaaagagagtgagagcacgagtggactaatgtctaatactgcagactaaattttaatggtaacagtagatttttattaacctacatttgtcaatgcttttccatttaccaagtgctttctcatatgttggttgccccaacaaccctgtgaagttggcagagagttgggtgttctaaaatcacacagcttgaagtcaaagtgtggatctcaaatccaggtcatctgaattgcagtatagaattctttccttctgttaatattctctttttaaatgactgttaattcgtgatgatttccaggtctgaatgtactcataggatctcttttttccccttatgtgttttattgctctgaatagtcctagagagaaaagatcagattaagtattttttgttcattactatgaaatgttgagtttcaccatttttcagttatagtccagtgtatagcaagttttaatggggacaaagtccttgcagagcttaaaaatgaaaccttcttaataggaaaaacataaccttgttaatggaagttttggttgctttccagcccaaaaatacatttttagaaatatattaattaacactagaagttataatttccttaagtgcaaagtattatcataaataaggttgaggaatatggaattgctcttcttaccttgcagtcacatctcatacaatgctaattgtgccatacgcataagtaatattgggttaaaatatctctcatgttcccttagagatgattagaatttttaggtggaaatattttcctattgtattagaagtcatttaatcagtcttaattcatacatctcctcaaaatgcctactcttaaaatcaactctttggcatactccgccatctgaatatttgctcatttctttccaccttttttcagacttgattctgtggccctatatcatgtttgtgaacctcatgttgacgtcagtcagcatttcagttcagtattactctctataccataaatcactggagtttctaagtctctcattagcttgattcaaatcttacataagatttagttagtgtcagaacaattcaactgtgcacaaattctggtcaaacaaaaactataagaattgagatcattttagaacatctgtagaaaagtagtagatttgatagcctattataattctgttagctcattaatataacaaatttatgaaaatattgtggactcttttctagaattctttaagatagattaagttttcttatagtacttcacatatggttttgcctggataaaaggcaatatatctagaatctttgatctcttacaatactctccaaggaaaatggtcagaataaaaatttcaaatgtcaatatctggtctataaaaaattctaataagtgctttttaaataaaacatttcaatagggtatttttattgtggtgaaatatatattgcataaaatttacaattttaactaaagtgtgtaattcagtggcattaattaattcagtgttttgcaactatcaccactatttccaaaaccttttcattacctaaacttaataagtgcttttgaaattacaggaaaatattaaaacttttctatgccggttgactaaccctgaataatgccttgagttttaataggtcagtaaaaatgttttgggtcaaaaacagagtgttcattttgtaatatttttgtttcttactaggataaacttaaccacatcttttggctcattgattattgttaaaattcagtttttttggggggtagggtgattgcttttgtgagccttcttttaatcctttttatcagagtatcacaaaattaaactcaacatctgtttaacatcagagagatttgatgatcatgtgcgttgccacatgtacagtccaaagatgaaactcagttcagtttaaagagactccaaaaacagatgactaaaggaaacagtacttggaaatgggagtgagagaaacattcatcttactgagtcattatgggtcaaagccttccatgtactgtgtaaaaaccatagaaagaaccagtttggtaaattccaatgaagtgatcatacattgagcacatttataacttttcaatttaaagcattggtccatttgcttttggataatagtggggatgatttcctagtaactgatgatatgtactagtaagtaataaaactgagtttccctacatatggtgtgtttgttataacctacacctctttcttcacctataaaacacatatttgcccctaaggatctaaattaaatactttgttttgtgaagtcttcctcaactcccatagacagtcaatcagtcttcctttggtgttaataatatgctataagaaatacatattatagcaaacatcacattaaattcctgttttttctacactgtgagctgctcaagggtagaggctatcttttattcctgcttatattctcagtatagttcatgttccatagtagaatcccattaaatatttgttgactcactatttgaatggatgaactgatcaatgtaagcatccatactggagtcttcattttttaacagcatctcaattataagatgttcatattttatttactaaggcaattagcaaaatatatatagggttcagtcgtatgcattgaggcagcagacatttccatttatgacataagctgaaggcaaagtattcttatcacaaactcctgggcatttgtcagtgcctgtagaaaactcaaatgacatctgcaatagaaatacctggatgtctgtgtttgttggttgtggggtttgagaaggcattacagggggatgtgtctcctccaagttgcctatgctagactgtgatatctccatcatctgctttgttcctgggcaaaggctcagcactggccccagtcatgggcactggttgggggaacattccatttgacatggcgcctaccacagaggtgtgctcgtgttggcactatagctgttaacagtaccacagaggtaatagcacagagggaatagcctgacccaaggtgtcaccatgcatctctgtgactagacagtgggacttcccttactcctctccaggctctgtttttaaattttttttatttttttattttattattattatactttaagttttagggtacatgtgcacagtgtgcaggttagttacatatgtatacatgtgccatgctggtgtgctgcacccattaactcgtcatttagcattaggtatatctcctaaaactatcccttccccctccccccaccccacaacagtccccagagtgtgatgttccccttcctgtgtccatgtgttctcattgttcaattcccacctgtgagtgagaacatgtggtgtctggttttttgtccttgcgatagtttactgagaatgatgatttccaatttcatctgtttatggatgtagatggcatttctctaccttcagtagcttcgtgggaccatcctttcatttcctctcctttcattttatctctcttccctttgtttcccttctgattcctcctttgccctgaaggaaagttatgaagctctaggtggcagagtgcaaatgggtaaagatggggtgttcattagcgcctgatgtattcactgtgtgtaaacccagcctacccatctcagagaccacctttgcctgaaatcctctatttaacatgtggcattcagagcagaagcgtctgaaaggcacatttcttccactaaacctccaagaggacaaacccagcaaggacatagtggatttatctgagtttaatggtattagcctgagaccagccatgatgtgccaaagacattggcaatttggaaaactaccaacagagtcctaatgtcagtcatgtctgtatagggctaccttggtgacttttttgctaaaattcagggacttagctggtctcctcagccaggcagttggagtgatttattttctgggactgaaatgaccagtggattcagtgaaagcaattagactgactttgtatagatactggaattttcctttcccatgattaacaaacagagtaattaagcctcgtttgtttgtgctcattctggaacagaacagctatggcaaagggggaggggaaaggggttgacttttctctggcactggaaatcaaaatgcacatttgtctttgtgtatacagaaagagagggaaaaagagaacaagaggggcagagaaggagagaggcagagaagaagtgaggcagagaacagaaattacctgctttagagagtggagtggggttgggactccctttccaggggttggaagattaaggcagcacttgggtctggaacactgctactgttccccaggtatggttaaatagatacatcttggcaacagattcagaatccccccccaagacctgtaattaaccgttacaattgcctatgttttccaaaatgaaaatttccttaaaacttaatccacatattttaaccttttaaatcttttgtaaagagataaatagcatgtgggggaagttaccccttcttgaagaatgacgattaacctgaactcagctataattataaggaaaggagaatctttagaaaagcaatggcagggtactaggttttatatcctgttgtacctagatttagagtattttggtttccattacagctgcctgagcatttcttcctctgtgtaagatgatttttagatttctcattcaccacatgctttaaattttaataacgttatagacatggaaggtcctgattttctgcctcttaccagtctcatcctcttacctcagctgctagaaactgttctctccacagtaagcctgtttgcatcctaaagccttcagcagtgagggtggaaatgggttcttgaatatcaggctcagagtggggacctgtgacctgctttccagatggaaaccatgagagccgtgcatgtagacatattcccaattgctgaaaacaaagaggtggtaagcacaggatggtgctggtggcgaagaaccatgtcttctcatttaacaaagactattcagaaaatagacattttagaacaaatctgaatgctaatagaatttctgaaaagggagagaatggatataaagtatactgtaatcaacactgggaagttctggtagaccaaaatgaatgtacagtttctgtgtggcagcctgcagccaagccagatggctgacagtgggccttaccttcactacctcttgagtatagacaatgaaaaaaattgagaacatggaaagagttttatcaagacttggaagatctttaaatcatccttgcatgtagtgcacaatcatggctcacacaccagctatcttgcttcccagttatgaaaatggagcactctgtccccacccccaacatgacccacaggaatctgtgtctcctggaaaggctggggactgcagtggccattgagaccaagtggaaaaaaaatctcagtgcacccagcaggccacttctctctagcaatatcaaagtgtgctgtttaggaaagccagcctcttccttagtttgagatcctctatttttatataatattaactctcatttcaatgtgaacatctgaacaaaaagttttttccaaatgaatagagccaaggggagatattgtattgagtgtggacagcagaatgagaaagaaaatgttttagtacttctagttccatttagtcttcttgatacttttctcttaggccaaaccactttgagtaacagaggtccttggctaagttccaggtggaaagaagcaaactggcattcagttccattctctttctcatcttgcccttttttgaggtagcactgactggtatgttaatttcactggttcatttttcatttaataaatatgtacctaagatttacttcatgggaagtgctgtgttagatgctagtgatgcaaagattaaaaagacaggttgcagcctggagtgactcctttgggtggaattaaggaagcatcaaggaatttagcaactcagtgggaaaggattggggtggagttctagagggggaatctgcttgagctgagatagggcagacaatgagcacgaggtgctcccagcaaggggaataggtcagacaaatgtgggtgagtgagagaatatagagggagccatgaagtaaatgatgaaataaatggagaagatgggaacgtgtacttttatcaagagttggagcatcttctcaattgtctttgcatgtagtgcataaaaccaaggctcatccatcagtcactcttggcctatggaaggtggggtctacatgaaatatgaccttggtgttatactaagcagttttgacttctaagtatttggtagggagcactgaaggatttgcagttgggacttacatgtccatattttcattttggaaaatgtattgtgaccctcagttctaaatgaccgagccttacttaaatcaccttatgcctaaaggaaattttgagtaaagttgaaatattctatgtcttctaaatagtaacctaaatttcatttagataattaaatatgtgtaactacctttctttctctctctctctcttttttttttttttggtctaagttggtctacagtgtctgaaagagttgaatggatttctttagaagcagaggaagtgtactttgatactgttggtgtgccatggatatacaagggcgcagggttagcctgggatgaatcattcacatgaattcagaaacattgctattaaatgaaaaaaatgtatttattatagagtagaatgcaattggcatgttttaaaaacaaacatgaggcatgaaggaagtttctactttgggctgaatctcaagcccttttgggtgggtgcctgcagtggggttgtcaagaagactgagaagcactgggctctgttgttgagcaaagccaagcacaagaaggtccttatgcaaagatggtgtgtcaggagaacatgtctgggtgttagttaatgcttgtggaactctcacaactccactagggggatgaggagctgggaaggtgggggttgtggtgggagggagagtcgtaattcttgtttcaaggcctggcttcttttttacaagatgattagctacatttagaaacctattctttacacattcttaattttgctggagttggaatatcttttcctcttctctgtgttggtattttatgagcagatcaactcaatctgttttcaataacattcaagttaatagtactatgacttagatgaaaagaaaattaaaagttatcaacagcttggtatacttaacccttcctaatgctgggcacattggctctcctttcctggatggactgagaaaattctggaaagtagttgcccaacaaaataggttagtactgtactgcacactttgttcagctttactgtgggcattgtcagatcaggttacagcataggatttaaaggtcaattatgccatgactttaggggaaagaaagagtgactagaaggttaaaaaaaacccctaagttttggcttttaaagacttatgaaattgtattccctttgtgacatttgatgaatcacttttcttaatttccattctgataataatctccctaacgttttcctaggaagctctttcatggcaaaaatactgtcctgtagatgcccgagagagttggggccagttatacagggtgggggagagttggggtagctactcctgtctctccgagttgatttgatactgcttccttgaatttactgaaattaagacacctgaagagattaaaattttgtggcataaaaacagtcacagctaggcatggaactggtttcagggagaatgaccaagttaggcatttagaggatgagaaccaaattacagatatacgaaaattagagaagccaaaatgaccccatgcattaatgaatggcctgagggaacatctgtggttgtctgcgtcttagcttacaaactgaatccagggacgttttcatcacaatgcctgcatctgaatagcatggaaggtcaccaggattaagagttttgacctgtcagcgcaatggggtttaggtttggtatctttatttttggtctgtaagctcttttgttcaaggcaaagttgatctctccctgagccaggccttgagtggaggtggactggcttcgtgtttctaattagtcagacactccccctgctcctgactactgatggatgtcatgttagttcaggaccccaagccctctctctctttgagctgcagtgcagggatccactttagtactgaactgtcatttgtatggttagcatggtggccggctgtcttgagattatgttagcagaccccctccctatccctggctcttgaccttttagcatacagcctcttggcattttcccaaatggaataatatatgtgtaagcacattgaacagcattatatgctgtttgctaatcagatgtggttgactgtaattatcttgcattcagttccttgttggtagatattctgtacaggtagttcattcgtattttggatcttgattaattttcacagtgccatatattgaccttgaaagaagtcttggtcagttttgaaaatctttaaccatgcaatggttagtccttcagccccaccatttactttggctgtctggcctcttacctgaagcatcttattacttgatctctacttcgaatgatctcttttccatcctttgggaaggacagtggcccttgtccctcaggggagaccctcctacatgctgtagctgtgaagctaaatgctcactggttcttactggtttaggggatatggggaggcctggcttgtcctggatccctatcttctactcatgcagtacttcctgtggttccatttaattgtacatttgtatgttggtcatttcaaccttgcttagtggccctctgtcctacttagagacagctaacttttttggctttctggaaaattccttgagatttgttgcagcattgcccactcctcagtcatgtaggccctgcctgtactgcttatcctagcttacattttaaatctcagtacctcaattcttatgatagccaattctatcttagtattatgacttcttgatgtccagcagaaaatattgcaatccattaacacacagagtagtgtagacagttaattgaatggaaatattactagatgtactttatagatgatgaacagattatgacattgtatagatataattgggttcttccttggagagattcatcaataataaaaacaacttttatttattgagaacatatgctggattgcataatgctctaaatatttcctctaacactttcaacctgtatggtgagcattggtatccccattttatagaggaaggacatgagatgcttgcctgaggtggaatcagtgttattgtgccagtatatctgacttcaaagtcagttttccattaggctgtgtggctatatattcacaaagaagaatcctagtggtgataattagtgacctactattggcaggagaagacactagcattctcttgaatgtacaccatatttgcttgtcaactgattgatccttttttgttatctgccagacgctgacatggtcttgaattttaaaggtaagtaagactcggctcttacctcaaacatttcatagttgagtgggggaaccacttgtttaatgtcactgattttttggtctgttttagaaaggtcatgaaactactacctttgagctttttcttattccaactcccttttttcccccccgataatggagaaaacttcttgccctaaagaaacgcaccttaagggatggcatggactattgtggatcttcatatgcttgtgggttttttttttctttaaacttattttgttactggagctgtgtgatcttttctttgaggtcaaattccacaaaaggagctaagattgtataattatgtttcacatctatagggcccctcatgatctataaaatgccttccatatacattatttgatttgcttctagaagggcaaatatttgatccctgtttcacagtggtacacttaggggccactcaagggtatgtgatgagctggacatgaccctgagttctccctgcctgtgacatacctccctttcaataagaggaagaggtgttgctggcagaagctttctggaagaatagaaggtgtattagaaggaaatgtggctatgtgcatccctattggtggggaaatagaaactaattgatgtacctcaccaggacaaatggtttggccaactggggcccagaaacaaagcagggggaagccatagaagtcggtgcctgaatcagctagggctgccataacgaaataccacagactgggtggctcatacaacagacatttattttcccatagttctggaggccaagaaggccaagatcaaggtgccagccaatttgggtcttggtgaggacccacctcctggcttacagacttttgccttctagttgtgtcctcccatggggatggggtggttagggcagaccaagttccatggtgccccttcctatatagggcactaatctcatcatgagagtcctactctcctgaactcatctaaccctaatcacctcccaaaggcacatctccaaataccgtcacactggaggttagggcttcaccatgaattttgtggggataccattcagtacatagcataatggtggagaggttaaaacatgtggaggaagatcgcactccaggatggtcagggcaagtgtgtgggtgtttaattgtgggcataaaaggcacaatcaacaaggttatagaaaacaatgtctcagtggtttgtttggactgcaagtaagaggaaagtgggacttgtgaatgcttggcataactcagctcttctctcaactcttggaaactcacagggtaaccagtccccctgaggaccagggaagctgtgacggatgggagagagtgttgtccccattgccataagcagaatgcagacgtgttatttatttatttttgaggctatacgaatatctgttgttttgaaatatattaggtccaaatttgaccccctgggaaagttttctgtcacttgagaggatactgctttatgtatgaccccactagaaagactaatccttggctgggcgcggtggctcatgcctgtgatcccagcactttgggaggctgaggcggccggatcacaaggtccggagttcaagaccagcctgaccaatatggtgaaactccgtctcttctaaaaatacaaaaaaatttagctgggcctgatggtgagtgcctatagttccagctacttgggaggctgaggcaggagaatcacttgaactgggaagcagaggatgcagtgagccaagatcgtgccactgtgctccagcctgggcgacagagcgagactccatctcacaaagaaagaccaatctttgtactttggcccaggtgcatggtgaagtgtatggtcttgtgttcttttgatatactcacctgattgagcagaatctcacacaagtcttcccttgcttccgaagttacaatgactcagtgacagctataaaagccttcttttcatggtaattataatcagacatctgaatacatttatgcatctatagcttctcagttttacacgtaaatagatgccatcagaagtattttgagggctgatttagctcgaagagggtccatttaaaacctattcttgtgttcccatcattttcggcagccaggcaactgaggtcagtgtgctcataaatggcttcgggtgagtgtgtgaattaaaagctcctctctgtgtgatgataacagggtattttctgctcacaattacagaagcatacattttgaaagtaaatagcctcatagttgttctttcaggtactaaagagccagtttatcaagaattaaggcccactgagttagggggcataaaagcagagtggacagggcagcctcaccaagatggagcttgagccaagcgtggtcctcctggccccttgtgggcagccagcaggctactgactctgtggtgcactaaggagctacctttttggactgcattacttaaacatcagagggtaagtattatgcacaaatctgaggaagattaagggatctgggttgctctgtaccgtgagagatgagattagctttccccagctggcgagactggagacattttaaaaagcattttaaccagagggttttctaagttctcctggaatccattaccatctattagctttgaaacactgactgccaaaaagatagggcagtgacagggcgatttgctctcctttctggtgaggtttgaatcccaaggtgccagatgagactggaagggctctccagacctgccgatagaggtagggagatattacacaaagcctgcttacaaatcgggcagctctacagtctcaaatataaaattcggtcattagcttacactgtcacgtttctagctgaatggcaagaggacttaagaccttctgtttggaaagtcagaaactaatgtttttgcttcaactcttaactcacaatgatgtcgtctcctgttgctgcacagtcctgtggagaaaatcagtcagtattcttgttttcctctggatggaggtgattttagagccattagtgcttctagaagcttccctcccctctgggtccctgaggggattcttttggtacaagtagacagagttgtcaacaggtgatcacggacctctgaaaatagtagtaaaagtagcaatcattattctgtgtgtcaggcactgtgccatgggcttttactctccaccgtatttaacacctcaaaatataataggaaagcccaccaacttggcatccattttggatatattttaaaactaaatttacacccatacatttatattttataattttagtatttttgataataaaatttgtttttttgatcacataaagtaaaaactatttgacatttcatctgtctgtaatgaccacaaatagcattttggtgctcattctttcatatatctctctctctttctgtctctctctacacatgcactggtgtgtggcatgggtataaatagattttcacaaattatattatatattttgtacttattgtacatagcttttaaaagttatgttttgttcctttccttccgttgatactcactccctgctcaccaccatcaaccagtgttgaacagcctagtttgtagatgtccacatttctatccatgtttatgtatatatttatgttttgttttctacaaaaagtcaccctccaaagcggtatttgtcatgtgcccaggatccattattcacaattcaaaatggtggacaagatattccaaaaaatgagattattgaaacatatattctctgtatgttacttttctcactcaacaatacctcatggactgcccttcctgatggtttagggctgactcactctgtaatggccttggaataggatatgaggtgggagaccaaccattttttttttttccatttgagtagtcagttgtgcatgtgccatttatcaataagctgttctctccaccatggatcacaagactcaccttgtcacgtagaagcttctgttgatactggaattgatttctgagttcatcagtcagttctgttgtttgttcctatgccatgttttcattttagtggatttaagtctggtatgatgctcccctcataattctttttcaaaagttttctgccaatttttggatatttgatattacctaaaaatgtattatatccacattaaaaattttgggattctaattaaatgtatatatgaattttgaatttatatgctttattttttcttttcctttttaatgacagtataatgctattgtaagttttttcaatttgcattacagatattttaaaaagccctaaacttttccagccacctgattaaattccttcattgattcgagtactttttatttttagagttggtgttcctaggagtatgaatatattattagcaagaagggaaaattttgtcttctcatttactctgtttatagtaactattttttcccctcaatttgaattataatgataacagcaggtatcccatcttattcctggcatttgattgtttggaatgatgtttgcaattgatttttgatgaatccatattcaagaggtttcttttattcctattttacttgaagttttattagaaatggctgttgaatttcaccaaatgcttttttagaacctattgatgtaaccaaccacttttactccgtgcatttgttgctctcatgaatgatggtaatggatttgctgatgtgaaaactgcctttctggagttgtccttgtttgatcattgacaatattcatttgatatagttttgggttttacttcataatgttttatttagaattttaacgaatatttacaaatgagattgctctgtagttttcttttattgtactgcctttaccagttttggttttaaggccaaaccagtttaatgatatggacttaggtgattttccctatgtttctattgttttgaataatttaaataacatttctttcctttaagttatatagaactctctgtgaaatcaactgtttttgccctctgctttttttttcctcttagaaaatcacttctcctatctctcctgtggtaactggtctattcaattttctacttgagtcagttttgttcctttatattttgtggaaagtcacaccaagaacttcagaatgctcttctctcttccccttctgcctgcagccctgcttcttcctaatgcctatgttttcttttgttcctgagtattactatacccttgaagtttgcctcttatttcagaaatctttaatatttatttacatgttctcagtcatggtatcattatccatttagatttcatagtgtatttgcaagatacccttctcaccactcttttctcctttcccctcccctgtccctggagatctctgctctgatttatttttgttgcattagagtctttcttggtgttttcctcagatgaagcatggggttgatttactattgaaactgcattattccaaagattttctttctaactgtataatcttgagaatgttatttaacttatctgggtctcagtctccttaactgtaaaatgggaattctaagaacagagaccttacaggaactttatgaagatgaaatgagttaatatatgcattctggttatctgttgctacattgtccttcagtagctgtgggacactggttccaggacaccctctgccctcccataccaaaatccacaagtgctcaagtcccttatataaaatggcttattatttgcatataacctttgcagctctcctatatactttaaatcatttctatattataatacctaatacaatgtaaatgctatgcaaacagttgttatactgtattttttatgttttaaaaaatatattctatctgtggttggttcacttcatcggtgtcgaacctgtggatatggagggccagcagtatataatgaactaccttaaaacagcagtgtgacaactatgtattattatctctcataggtctatgagttggctgggtttagctgggcagttcttgcttgggggctgtcatggttggagtcagatagcagcagtggctggagtcatctgaaggttcagctgggctgggagtcccagatggcttttttatttattgtttcagtgttcctccatgaggcctctgtctccatcagagtagcctggatttcttacctgctaactcaaggttcccagaggcagaaaactgctggtcttcataatgtcttggcccagaactggtgtagcagtgcttcaaccacattctatgaggtggaagaatacactctaccttgagttggaggagtggcacaagtagagagggagggaaggaattaatgatagccacatttatagacaaactaccacaataagtgaagtgcttagactagaatctggcactgaatgagtgctgtagaattattaactcagtgatattattgcagttgttaaattaccttcagaatttgcttttactctgagagctgaatgatgtcttgtatgagtatagaagtctaggactgtggttcttttctgtaagtaatgtgcagatgaagtgtgatgccagtctaatgacttttcctttgtaggcaagctgttatttttatctagaagctttcaggatttttcagtaaaagcagaaataagatagttatcaccacttattaacagacctttggaggttctagaaaatataagacaagaaaaggaagaagtagatgttgaaaaaaataaaatatcctctctgtgctgatgattatttttagcaagcccaggaaactccattaagaaaaaaaacaactaactagaattaaagagggaacacggtaagatgagacattacaagataaacatgtaaacacaatagcttttctttttttctattctagcaagtaccatagtttggattgatagaagtcttttataatatattcttaacctggtactggacgagctctttcagttcagttggatgagacttcttatgccaactgaagtcttttaaaaaagcagggatttttttctcttttatttcttcagttactgtctctcttccatatactcctttttctctattatttgcttggctgtgatatgacaattgccttttcatgggaagatttgttcttttgttgtaaagttctgtttttcctattgtagaagattatcctttatgatatgatgggaatagcaaagatggctttgtgtgtgtgtgtgtgtgtgtgtgtgtgtgtgtgtatgtgtatgtgcacactcgttttgttgtttttgtctcctggctgtcctgaaagtgttcccagcagattttcagagggatgctgctttccttactttcctgttactgaggaggctagagtggggaagggatgggggtagcagagaagctttcctggagacctccacaaaggacaggcagctagacctgctccagccctagccctctcatggggttgttgctgttcacagttcccaaacagctcgacctgaattgaactctgagggtgaatagaacaatgagaagcctggaaaccaacataaggggactcagccaccagaaaataataagcagaaggtaagtggtgcaagtcaaacagaatggatagaggagaaggtttaatcctaacaaaaaggtataaaataattccattgcaaaaaatgaagttttctagaatttaaacgagtagtttaaaaatgagacattcaatatatggaaaagatacccaagaaattgctaagagattacctccagagaggaggcaaagggatggctggggaccaaggtgagaagatgacttcctttattcattgacatttgccactatgccaaaatgatatatcatgtatatatgcagttatgtagttgaatggagaatgaagaggaaggtgttaaaaaaaaaatcaagcagtggtgttaggccagggtggaaatttcctgtttatgaattatagtagaatacaacatttaatttggaattaaaaaaaatacatcttttttttattttcttctaatgaaactgcaacagtgttattagtacctgtaactttgtcagcaatagaaatcaaaaatattttcatataatattacagttgttgcagacatcttgaatgtcatttatgttcatcagagcttaaagttataattgttcatagtaccaccactagagcttggtatttaatgtcataataaaagcacatgttattgagtttgtgtattttagtattttgatacttaaataggattggtttccttagtaatcctatggatttcactttatacatttaaacatattatatttggggtagggtctctagctttcattagactgccaaagggatcatgccctcaaaaaggtcaagaaacctatgggatatagggaccattggagtaaactattggcccagaagatcaagtggaagagcaaaaacatataaaaatataaaaataaaagtggaaaaaaaccaaataaaatataaataataaattataaaataaaatatataaattataagtatatggataaataaaaataagtacataatgaaataaataaaatcattagagggacataaagagacttggaggacagtctaacacacccaaaatgggaagaacagaatccttcataataaaaggataaatcttcccaacaaaggatggtggttgggaacattatgtctaataaggcttttgtcctttgttgttgctttatttggatgctcattttaagaaaaacacagcattggcaaagctttgttggaccacacttttgctggtccacaaaaccctccagctgacaacccacagatgcagggtggaaaagcctgtgtgactgtcggaggggagcagctgggtccttcccagcacactgcagctggagagagtgtcctggcagtgggaagtctcagcacaatggcctggtgcttttccacctgtgagaacagctagtgagtgatgcgtgcgctgcgttggcagcagctgcagtagtgtgtccactgtctgagcacttcttgccacttattctaccctcctgggttacccagctcttaccattcttatagggggtaatgaagacatggatttgagaacccttgaattgtttcctgctgatcgataggtcgcacatggctgtttacctagcaaacggaaagcaacatcagttcttgagactggtgactgtatgtgagaaaacgataaaaggatgggggcagggtgtgtgtgtgagtgaatgccgcattggtgtgtttacagttcagtgtctttccggagcatgagagacgaacaagtattgtttaaacgaatgctgtttaaaccctgggattatatagtcatgtgaacttttttggaggaaactgcaaatgttgctagccattgtaattgtgttagttcttgactaaatgtcgtatataaacttcctggtaacaattttaataacgtttgctacttaattataacagcattttacaaaagtgtcagggcatccttaatttatgttttgataagagtgaaagattcagaaagtttgctttcagttatctaaaacttggggccttctccagcatatgcaaacaaatagtaatgcttaaatgcactgtgtgtatgagatgggtttttgtttgtgtaaatctagatggatcctcactccgggggcttaactaaattgggatttacttttctcggtaatatgaagactggtagtgggtagctgaaagcaggtatgaaagctttgggggataccattctcatttcatctttccatacctcgtgctcccccaaatgacaaccatgcctttgggcttcttatctgtatttcaggcagctagaaggctgaaggacaaagaaggaaaagcaaaagtccagtgcaaagctttcttggaaggcctgctagtggcttccacttacatctcattgatcaggaatgcaccatatgtccatcagtatggatccatctagtggcttccacttacgtctcattgatcaggaatgtaccacatgaccatcagtatggttccatccagtggtttccacttacatctcattggtcaggaatgcaccacatgaccacctgtatggaattctgggaagtgtattttgggtcaggccggttgccaccctgaacaaaatttttctattcataatgaagaaggagtgattggatttgggatatgtaagcagaagtgccaggcacaggagccttcaccattcccctctatctttgttccagctgatttctgctcatctggaaggctctgtctgtgccatctcttccaggaagccctctgtgagccccaggtggggttaagtgtccattcttcgagcattgatggtactctgtatccacacatctcatattccctgtctttttccacatacacattttctatatctggtggaaatctctactttaggaatattacctcattatgcttgtaagtgccttgagagtaggatttgtgtccaatgtttattcccagatcttttatttttagtattattttaatttaaaatttttaaatctcaataggtttttggggaacaggtggtgtttggttacatgaataagttcttcagtggtgatttctgagattttggtgcacccaacacccgagtagtgtacactgtacccactgcatagtcttttatcccttgccaccccccaccccttcccccgaatccccaaagttcaatgtatcattcttacgcctttgcatcctcataacttagctccaacatatgagtgagaacatgtgatgtttggttttccacttctgagttacttcacttagaataatagtctctggatacctaattcatgagaggcttaaaacctagatgacgggttgacaggtgcagcaaaccaccatggcacatgtatacctatgtaacaaacctgcacgttctgcacgtgtatcccagaacttaaaaaaaaaaaagaataatagtctccaattccatccaggttgctgcaaatgccattatttcattcctttttatggctgaatagtattccatggtgtgtgtttgcgtgtgtgtgtgtgtgtgtgtgtgtgtattacatttcctttatccacatgttaactgatgggcatttgggctggttccatatttttacaattacaaattgtgctcctgtaaacatgcatgtgcaaatatctttttcatataatgacttattttcctctgggtagatacctagcagtgggattgctggatcaaatggtagatctatttttagttcacttaggaatctccacactgttttccatagtggctgcactagtttacattcccactaacagtgtagacgttttcccttttctccttggcatccatgccaacatctgttatttttgattatggccattcttgcaggagtgagttggtattatattgtggttttgatttgcatttccctgatgactagtgatgctgagcatttttccatatacttgttggctgtttgtgtatcttcttttgagaattgtctattcatgtccttagcccactttttttttatttttttattttattataattatactttaagttttagggtacatgtgcacaacgtgcaggtttgttacatatgtatacatgtgccatgctggtgtgctgcacccattaactcgtcatttagcattaggtatatctcctaatgctatccctcccccctcccccaaccgcacaacagtccccaaagtgtgatgttccccttcctgtgtccatgtgttctcattgttcaattcccacctatgagtgagaacatgcagtgtttggttttttgtccttatgatagtttactgagaatgatgatttccaatttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcagtaaacatatgtgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctttccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaaaattttctcccattttgtaggttgcctgttcactctgatggtagtttctcttgctgtgcagaagctctttagtttaattagatcccatttgtcaattttggcttttgttgccattgcttttggtgttttagacatgaagtccttgcccctgcctatgtcctgaatggtaatgcctaggttttcttctagggtttttatggttttaggtctaacgtttaagtctctaatccatcttgaattaatttttgtataaagtgtaaggaagggatccagtttcagctttctacacatggctaaccagttttcccagcaccatttattaaatagggaatcctttccctattgcttatttttcccaggtttgtcaaagatcacatagttgtagatatgcgccattatttctgaaggctctgttctgttccattgatctatatctctgttttggtaccagtaccatgctgttttggttactgtaggcttgtagtatggtttgaagtcaggtggcgtgatgcctccagctttgttcttttggcttaggattgacttggcgatgcgggctcttttttggttccatatgaactttaaagtagttttttccaattctgtgaagaaaatcattgttagcttgatggggatggcattgaatctataaattaccttgggcagtatggccattttcacgatattgattcttcctacccatgagcatggaatgttcttccatttgtttgtatcctcttttacttcattgagcggtggtttgtagttttacttgaagaggtccttcacatcccttgtaagttggattcctaggtattgtattctctttgaagcagttgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctagatatacaatcatgtcgtctgcaaacagggacaatttgacttcctcttttcgtatttgaataccctttatttccttctcctgcctaatttccctggccagaacttcccacactatgttgaataggagtggtgagagagggcatccctgtcttgtgccagttttcaaagggaatgcttccagtttttgcccattcagtatgatattggctgtgggtttgtcatagataggtcttattattttgagatacatcccatcaatacctaattgattgagagtttttagcatgaagcgttgttgaattttgtcaaaggccttttctgcatctattgagataatcatgtggtttttgtctttggttctgtttatatgctggattacatttattaatttgcgtatattgaaccagccttgcatcccagagatgaagcccacttgatcatggtggataagctttttgatgtgctgttggatttggtttgccagtattttattgaggatttttgcatcaatgttcatcaaggctattggtctaaaattctcttttttggttgtgtctctgccaggctttggtatcaggatgatgctggcctcataaaatgagttagggaggattccctctttttctattgattggaatagtttcagaagcaatggtaccagttcctccttgtacctctggtagaatttggctgtgaatccatctggtcctggaccctttttggttggtaagctattgattattgccacaatttcagagcctgttattggtctattcagggattcaacttcttcctggtttagtcttgggagggtgtatgtgtcaaggaatttatccatttcttctagattttctagtttatttgcatagaggtgtttgtagtatcctgtgatggtagtttgtatttctgtgggattggtggtgatatccgctttatcattttttattggtctatttgattcttctctgttttcttctttattagtcttgctagtggtctatcaattttgttgatcctttcacaaaaccagctcctggattcattaattgtttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatcttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggcctcctttgtctcttttgatctttgttggtttaaagtctgttttatcagagactaggattgcaacccctgccttatttgttttccatttgcttgatagatcttcctccatccttttattttgagcctatgtgtgtctctgcacgtgagatgggtttcctgaatacagcacactgatttgtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcaatggtctttacaatttggcatgattttgcagtggctggtatcagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttgtggttaacccgaccgttctctctggctgcccttaacagtttttccttcatttcagctttggtgaatctgacaattatgtgtcttggagttgctcttctggaggagtatctttgtggcgttctctgtatttcctgaatctgaattttggcctgccttgccagattggggaagttctcctggataatatcctgcagagtgttttccaacttggttccatcctccccatcactttcaggtataccaatcagacgtagatttggtcttttcacatagtcgcatatttcttggaggctttgttcgtttctttttattcttttttctctaaacttcccttctcgcttcatttcattcatttgatcttccatcactgataccctttcttccagttgatcgcgtcggctcctgaagcttctgcattctttgcgtagttctggagccttggctttcggctccatcagctcctttaagcacttctctgtattggttattctagttatacattcgtctaaatttttttcaaacttttcaacttctttgcctttggtttgaatttcctcctgtagctcggagtagtttgatcatctgaagccttcttctctcaacttgtgaaagtcatcctccttccagctttgttgcattgctggtgaggaactgcattcctttggaggaggagaggcactctggtttttagagtttccagtttttctgctctgttttttccccatctttgtggttttatctacttttggtctttgatgatggtgacgtacagatgggtttttggtgtggatgtcctttctgtttgttagttttccttctaacagacaggaccttcagctgcaggtctgttggagtttgctagaggtccactccagaccctgtttgcctgggtatcagcagcggtgtttgcaaaaccgcggattttcgtgatctgcgaatgctgctgtctgatcgttcctctagaagttttgtctcagaggagtacccggccgtgtgagttgtcagtctgcccctacttgggggtgcctcccagttaggctgctcgggggtcaggggtcagggacccacttgaggaggcagtctgcccgttctcagatctccagctgcgtgctgggagaaccactgttctcctcaaagctgtcagacagggacattttcaatatgtttttctttataggttacctgatacttttgcctcacagctcttaagattcgttccttcgtcttgactttaggtaagctgaggactatgtgcttaggcaatgatctttttgcattgaatttcccaggtgttctttgagtttcttctatttgaatatctagatctctagcaaggctggggaggttttccttgattatttcgtcaaatatattttccaaacttttagacttctcttcttccttgggaacgcctattactcttagagttggacatttaacagagtcccaaacttcttggaggattttttcattttttaaaattttttctttgtctttgacagattgggttaatttgaaagccttgtcttcaagctctgaagttctttcttctgctcgtttgatactgttgtgaagacttcccagtgcattttgcttttctctaagtgtgtccttgatttacagaaggtgtgattgttttttatttatgctcttcaatttcactgaagaattttccttttatatcccgtaccatgtttttgatgaatttaagtgggactttgcctttctctgttgcctccttgattagcttaatagtcgactttctgaattctttttctggtaattcagagattttgtcttgttttggattaattgctggtgagctggtatgatcttttgggggtgttaaccttgttttgtcatattaccagaattgtttttctggttctttctcatttgagtagatgatgtcataaggaagatgtgtgattcaagggctgctgttcagattcttttggcccatggggtgctcccttgatgtggtgctctctcctttcccctaggaatgggccttcctgagagctaaactgtagtaaatgttttttctcttcttggtctagccacctagcagagctaccaggctccgggctggtactgtgtagtgtctgcagagtcctgtgatgtatctcatcttcaggtcttgcagccgtggataccagcacctgctctggtggaggtagcaggggagtgatgtggactctgagggtccttggttgtgtttttgtttagagcactgattttgtgttggttagcctccagtcaggaggtggagctttcaagagcgcatcagctgcagtcctatagggaggatgcacacttgccctagggacacctggttaagcattcaggtttctcaggtggtgagcagggccatagaactcccaagagattatggcctttgtctttggttaccagggcaggtagggaaagaccaccaggttggggcagggataggcatgtctgagctcagcatctctttgggtggggcttgttgcagctgttgtgggggttgggagtatggttcccagtccagtggagttatattcccagggggattatggctgcctcttttgagtcacataggttgccagggaagtgggagaaagctggcagtcactggcttcgtcctgcttccacacagctggcagtcctaaaggctggtctcactcctaccgtgagtaggagggctcactaccagggctgagaacttgccccagaccatgagccatcgagaaaagaagcagcagaatcacagtttttcagcatcttagggggcctgcagcagtgattcagttccttctaagggcctgtggattctctcagctttcctggtgtgttcctgtggtagttcttggagcaaaaggtcatgatgtgcatctccacacactgctctgtccctctgagcaggagctgcaagctagtcctgccttctatctgccatcttaatccccagttcccagctcttaactcaacacttggcatatagtaggtgctcagttgaagtttgttgacttgaactgtcaaaaactagtaaaatttactgaaatttaggggtctcagagtacttctaatttttataaaaattccttttttatttttctcttttttgagtataatgcatacgtttgtaagtgcatctgttggatacatttttagttgtttttaatcttgtaaaacatgctggtggtttgtgccagtatacgtgaatatttgtatgtgtttgtgatttgtatctaggtgcagttgttaaatacatgagccatttcctatggcatcaagtacttttgacaagtgtgaaccaagtcggagttagaaatggtggtctcagacataggattctagtgctgtgactaaggtgcagtttacccctcagggatgttggaaaacaaatgaggttgtttacctgaaaagtaactcttgcttctccagtgaaaagtcctatgctaatttctggtacagttaatcctctattccccatgtcaatagaaaaaaaaaagagtgcagattgtctaaagtcgttgattcctgattttgaattgaattataatgtattttggatgctggcaggaaaccagccttctgtgtggataaaacaaggctattgttcatgcgagtcagtattcaataaatctgtattatgagctcttgtctaagccctatcaggggcaggtgatgtgtaatacatttgcattatgaagggcccaggcaagtacaatacatctgaatgtatgggtgtactcaagttccatctgtgttttctatttagatcataggaaagttatgtggcctcattaggtttgtaaatgctttcaccatgttacatttcattgttttactgaaatgcttatgtgaagagtatctccagatcttcagcagaactactgatgaagtcatcgaccattaggattagtacagtggaatggttggtctaaggtccaaagtgtggtgccagatcagcaacatcagcatcatctaggaaactgttagaaatgtagtctcaagctccattccacagacctaatgactcaaatgggagtggggtccagcagtctgttttaacaagccttctgacgcagcgtcaagtttaggaaccactggctaagccgtaaaatcaagatgttttcagtgtcttgcataacatctcagaattcatcatctggtaaaaatgtgtgtgtattttttttttttataaacaggtatgaagtctttctccagacaacaagagtgacatcactcgtcatgtttccatttctgccttttccttcaggaaacttggagctgtgcttattgcttaatcataggcattccatttactccatttgcctgggctttttatttcctcttcctttccatgaattttatttgcttgttttatttaacagcctttctatgaatcttttattataggccttctcaaatccattttgctagttagtgggttggcagtgtggggtgcgatataatttgaaacaaattgactcactcacatgatatgattgacagtggaagtatttgacaaagaaatgatagtaggggaagctagcatggaattaagcatattttgcagaataccatgtatgcccttgaatacttacacatggtaagacaattcaaacagtatagagaaatataaaatgaaaagtttaaaacctccctcactcccttagtgatggctctttccccaaagataatcattaacacagtttagaaaataaaggttagacatagagcccacatatatatgtatatgtatttatgcatttgctttttaaaaatcacaaaaaggacctagtgtacattcttgtttgcatctttttttctcgtaatatagcatatggtcttcttattaaagtctgtacgatattcttttgtatgattgtactttataaacctacctcctattatcaggtatttagattatgtgcattctcgcctatattatcttgacacacttttgaaatttatcagctaggaaaattcttggaaatggaattttgggattaaagagtatatacatttaaaaaatgaataggtactgcctagtaactttccagaaaatataaattaatttgcttttcaaatgagactctcttttcccataggatattatcaaatgaaaacctttttaccaattttatgggtgtagaaatcgaatctaattgttttgattcacatttctttaactctgataaggttgagcatttaaaaaagatttattagctaattttatttcttttttttttttgtggactggtgtttagagatgacacttatctatgtttttcatgatctaatcttcaagttcccatacctggaaatccttagaatccatcagagaagctatttttgttaattttttttaatacagattttctgattctactctagagttctcgagtctgtttctcaactcttaatagcctgcttttacagattctgttgccaatcagtcaggtgtaggctgtggtccaagagcagcataaacatagcatctaagggagctttctcacaccagcagtgtctctgctgtctatatccaattgactagaaatcagttttcaatattgcattgtgagcaatattatcgttggaagccaaagtactgtgtcaactttttttaagcaaaaaaagtatatgtaaaaagtaatatcatattaggatccaaactgccttttgtggcagaaatgaaaatggaatatagagaataattttttctaggagaattcccatttgtgaatgatgtgctagttcagtgttttcctttcataatcattaactcatcatgctctccatactaccttttgagcctagaagcccagagctgaattttaagaccaatcatagcaactgtattttgctaggtttctgatatttatatttttttccgaatttctattgtttttgagaatgttacactcatctccaaaactctcccagggcttgtgttttcccttcttcttgactttataaaggatcaacacatctttaagtaccatctgcagttggccttttcctcacccaagggaaactgaggatatttgggagtcccgaactgggtcctccagacaccctctgttactcagtaattatggcgccaacatccggccaggcagctgttccttgcccaggagagactaagatgggggaaagaggaggttgagtttgtgagttactgggtacattttctaccttctgatttactgcaacatgatacagaaacatggataaataaaccagcccaaattttctcatgtgtaaagaaaagtgaaatgacgagatagagagagagagagattagaaaaaagaagaatttcatctttctactatgttacagacttaccacactacagtttatctggcccgaaattcttttagttgttcatctcccacttattttattctcctttccacctcatttctgtgagatttgcactttccacttattcttgaaatcagttaacagttaatctattccctggcattagcacttcccctggggacttacctattgattggccttttaatctagttgttaaaattctcccaatactcactgacatggagcagtttcaatttgtgtgttttaaagtgttggccagggtcattagaaaagtgaagttcacatatctactttgtggcacaaggacagtacctggcaattgatttgctatgtgactgtgggttttggggaagaagaagggaagaggtatagagaacaattaccaagtctactctaattctggggtccatccgcattctgcaccatacagcgtgatcaataagaacatatcttataacctttacaggttattgaaaatgtgcataagttagggatactggccaaagggtggccacttgcatctttaaaatgtgtaggtggttctttagcaatctcagaatctatggccacttttccctagaactagttggtgttgtgtttgtatatttttacaaatttatgtaattagaaataggacttgataagcaatagaactttgatagatgttcagttaaagaacttgtaccttttttcttccctcagattaatttgtgttttatgccactattcagaaaaagaaatttcagagtattagaataagatataattttaaagtgattttattaaagcatttgttaaaacatttactaaatggtccctaatgtatttttaatactcactgttaatatttcttaaattctcacattctacagttttgtaatgacaaactttctcatccattaaaatctttctttggaaatagcttatggtttaaaggtgtttctaaaaaaatagtatttttaaatttgcgttatatttttgtttgaaagatggtactattctttgaaaaatcaaaacattggcctttagtagagaatatatatattaaaatcgcctcaaataatataaaattatacttttaacatttctgtctttcctattaaattatgattttctggaggataaggatcaactcttatacaaatctgaaccttcataactagcacagggcttggcccgtattgaattctcagaaaatacttcttgaataagacaataaattaattgcctctttggtgaagttaatatattctgtagtaccctggggttatgaaataccccatgaactgaaaggacaaaatccaaaatataatgacttagtttcttaaaatggtgacagtttagcttcttaagaggcattctgtggaggtcatgttgaggctgttggagcatttagaatggtggacaccagctggcaggcaggaaccaaaacagtcatggggtgcgtttgtcctcctgttacgttttgttcattttgaaccagtttacaacattaaaaatgcagtgatcttacaataaaagtacagacttctgaggtttcttaaaaactcagcagagctaacctcactagcccttgtggcaacattcagccagagctggtagtgggtgttccttatagatggacacacactctagattttatcactgtccaatgggaaagagacattctgtgggatgcatgctgtgtagtataaatatatggaaccctacaacttggtgtaggatgtggaggaatctgtgctccacagtcaggcagatccttttgaactggccatgcaaaaacaaatagggaaagcagggccagaatcaactctcgtccttagactggctgccaaacctcagttcctggagagagagcagagggagtagtatagatccccctctgcctggctgaaaaaggaggatggctctttagtgtggagtctgtgaagcacatggcagaaggcagggggcttgctaggggcaaagaagggggctaagcctagagatggtacaggcacattagaaaggactgaagcagatgctgagagcaactgaccgggagaaatatctctaagggaaatggtgctggagctggggaaggcttggagagctatcagactgcaatgcaggtctcacccttaacgaaggagagagagaagggaggaaggaaggaaggaaagaaagaaggaagggctgggtaggccttacactaaactgtaattctttttttcttggagacagggtttcacatcgtcccccaggctggggtgcagtggcatgatcacggctcactgcagcgtcaacctcctgggctcaagtgatcctcccaccccagcctcctgagaagctgggactacaggcgcacaccactgtgccaggctaatttttgtaatttttttttgtattttttgtagagatggggtttctcttcatgttgcccaggctggtcttgaactcctgggctcaagccatctgcccaccttggtctctcaaagtgctaggattataggcaggagtcaccatgcccagcctaacctgtaattctaagaaagtttgacaaagctaacaatcccgagtcaaagttgccacagttgtgccttacagacctctttttctactcaagtttgaagagcagtgcctccgtgacttccatgggctgcttttcctgagagagaactcagaagaggaaggttagcatgacaaactatatgccttcctcaccacagttaatttggggtctgcagtgggtactcatcttctccttcctgagctgcccactctgagttctccatatccctaattatcaccttggtgggtcttgctggcttacttaatgatgtgacccaaatcctctttcctgggggaatgaaacctttgtagtcatgcccttcagaggctgggattgctgcatgtgtctgttcagttatagtggggtaagggagtatcaggaggcacccacatgggttgcctcggtttcatatgtattcctctctgccttacctgggtaaaaacagccctgcctcttcctgccaattagggtcagttatctctgccatttggtccctggacacaaagaatccagggtgccctcgtggcagctataactgtagttcagtgggacccttgctaagttctttggcaagagggtaaggagcccaggacctcccttacaacgcccagagttttgtgaaggagaagcatagaatcccctggtgagttatcaggagtgctaataagcggggctactcctgttcttggttttggggcccatgccatcttcctattggagacagcaccccgtggaggactctgatgcagtgcgtatgctgcatcctgaaggacagcaccacatcctttcagaagatcgcctcctagctggtgcttcacctgcacatttagaaggcagttctagtgttctgtgaggcctgctgcttatgagtggtgcgatatgtgatacaacactggattccatggtcttgggcccaatcttgcatctcttttctgtgacagcatgggaagatgttatgctgtacaggatctcgtgcctatggaccagccagtccacaagcccccaggtagcaatgctggctggggctctgctgggtgtgagtgcctttatgactgggcatgcccaatagaacccagctcatgatgggtagttccagattcaggatcactcattatcacatgggcaacactccattgttagcaggaatcagtaacatgccaagggcaatttcttaaaagggctttactcttctactgcagatgacatggacttgctccagaatcccaaggcctattttatgattctcccactggggctcgccataagctctatactgccttgtatatactgataaagcatttagactttatcctgtgagcagtggggaaccattgacagtttctaactgtggacctatattattagatcttttagaaaactgtaatacagaatgtttggaaagaaaagaaacagtcagaccagcaaaaattaagcgtctgaactaaaatttaggccataggcatgatgaagaaaggggaagtgatttgaagagtatctagaaagtaggatcagtaaaatggggagactgcatgttgggagggaaaaactgtctagaacaattctggggtttgggggtctgcaaagtaaccagaaaggatttcatgtgttaaatttttgatgctgcattttagagtaaagagttcccaaggactataccactaaaagaaacttgacctgtgttgagctatatttaatcagctggatttttaagtgaatcccaatattaattcatattgaattaatttttttcttccaaaaaatactgagctgggataaactagaaatataatgaaccagaatatcaatattgttttcatctgttttgttttctttgtaacaccagaacctagagtagtacctaatacatattagacacagtaaatatttattaaatgaatgaattttcccaactaaatcaataatctgaaatttgtgattcatttttgccatgagcattgagttactactgggagatgttgaacttgcagtgtaataaatattggaggagaaatgctttgttcactcgtcttgtggtaagcaggactgattgtattaaattacagacaattcggatgttttctgattttgcatgggctcgatctctatggcctcatcaaatcttcacagcaggaaggcatcaagagagatcctcttttttctcctgttgattataagccaaagggaacaaagatttccaggcaatatggaaattcctttgtgacacaattgtaggggaagggaaacccccacattcttactggtccaaccagtgcaagctgcgattcgatcatttcctttttttccctcatgtctaggagtttattctaagaaaataatggggcatagaccatataatgtagtagcaaggatgttgctcacgcattatctagaacataaaaatttggaactccctgaaatgagtaataataagaagttgaaatgggggacatggccctttaaaataacctacattttgatctgtattgataagattttatagttaaagcaaactgggttaaagagaaaccaacttctaacatatggaaacacttctttcctctaattctctcgagaccttgcgctatttctcagatacctgtccacaattttcccattgactttaatagcttgaggagaagctagcagattcagagaaggcctagagcatttggccagttggcaaagtgcgagtaccccagagccccaggtttcaatgtttgcttccttctcttcacccttcttcagcacccagctttcacatgcttgctttatacttcttaaaacctaaatgaccactttcccctacagtgacacattcttagcatgtccaggatacattgagcaagccagcctctctcaaaggcagttcttttgttcaccttatcttctaactggctgaagacttttaaaacctggcatatgaaaccaggctgcttcaattcaaattttgagtctgccactttctataatacaattataggtgacaattgatcttccttagcttactcatctgtaaaaactgggattaagataataacctacctcagagggtaattgacggagtcaaatgtaaagcatggaatgattcttttcaaataatatatcattttcagccatcaactacaaaagaaaggtgagggtggagtgtttctttgtagtacttctgcaggtatgatgcctggtctatttcatttccttttgatccccttttactgggctctaatgatcaggcccagaatatctcccatagaagcagctgtgttatattttcttatttaattaacgttgatgtgttggtatttcactgggtaatactcattcttcttcaccctactcctaattggttctgaggtcacagctttaagtgattggattttattcatttatcattaattaagaactctactgtccagtactgtagccactggccacatgtgactatttaacttaaatttcaattaaatacaattaaattcagtgcctcagtcacacatttcagttgtggctagtggctcccaaatcggacagcattgacatagaacatttccgtcattacagaaagtcttattggacagctgacttagacccttccttttgctacccttgttatagagaatcactgtagcatttatcctcactacctgcgtgctctcatgcacagacaagctggcagaaagcttcagatccctataagcataaaaacaggaattagaacaaccagttatctcatatcaaatgctgatccttcaaagacttttgatcaaattcctttgcctcttgtaggataattctctacaatatgtgctcagggtgtgtgtgtgtgtgtgtgtgtctgtgtttctttctgctcataaggaaaaagaccttgcaggatacagtgtaactacagaaattgtatggttttgatattggaactatgttattctacgttacagagtgaaatcagaatgaatgtatcattagctttcctgttgattcctgactacattacttgtatttattcccttttgcctgaatcccaggcctgcctgcttttccgctatgaataacatcagaataagtgactagaaagagaggccagaaagtatgccacctttagagaggggtcatgtaatcaaggcttagttctcacaagcatagttactcacagtccagatgtcagggcgggggtcccagtgagctgaaggcatctcagtgtgccactgcaaacgaggacattgaactgcagggaagttttattgctcaagttcaccctgctctttgtagcagagcaggagtcaaagttcaagtttgcagtctgcaaaagctgttcttttctggttgctccatgctgcctctgaaaatgttggtgtctgtgtgtgtttcatttctcaaaatgtgaccgtcccgctggctacctttagagtaataggtgtgagtgtatgttcgtccctggagaggcctcaagacattttctcttttgttgtcataaaaatcgagtgtgcttggctggaaaggtagagtgtacttcacctggagtatttcaagggtaacaccagacaaccacttccatcaagagggtgaaaaacactttagggaagttactgccaaagaagtgaagagaatcccatcaggtttagggctgagcattgtagaaaccaggaaagatgccatggtagtttcataggtcagggcctgcctacttcctttccccaaagactcggaagacccacaggcaggatagagagaggagacctggtggaatacatcgtactgtgattatgcgggactgctaagagccccttaactgagccgtgtggagaacttctcagtgctgtttgctgcagcctgtggaataacagaatacatttcgggctgtttcttcccgctggcaactttgcagaagcattataaggtttcccaaactgtgttgcaagttagaatcacctggaggattcttaaaatcccagtgtcaaggtcgcatcccatagcagtgaaatggtaatgggtgagagccatcatgaggagtttttcaggatccccaggggattccaatgtgtagcaaatttggaaaccttggccctttttgataccctctttctttaatcccagcacttttctttaatcccaccactttctttaatcccagcactttgggaggccaaggcgggcagatcacttgaagtcaggagtttgagaccagcctggccaacaaccctgtctctattaaaaatacaaaacattagcccggcctggtggcgcatgcctgtaatcccagctatttgggaggctgaggcaagagaattgcttgaacttgggagacagaagttgcagtgagctgagatcataccactgcactccagcctgggtgacagagcaagactccatctcaaaaaaaaaaaaaaaaaaaaaagtgtgtttttatttcttgatgtcccagtttctgtatctgtaaaatggagtaataataattacccctactacactgagtgttgtggggattacagaaagcacctatggaagcaccttgcacctactaggttgagccatatgaagttgctgtttttgtaggtcgaaaatgatgggatagtggcaatctaatactattcagtcctatagtaagtgctcaataaacgttaattgttgctgttattttccatgtaaccaatgtattttatttgaatataatatttatatttggcaatttttatttagttttaaagccatatatggactttaaagcttaatatcagttttctgtctgtattcataagtagtatcataattaacattcattagttaacggaatgggtgaggttctgtctgtgaaaccgttttctccttttataggagaaaacacttttcaaatttgagaaggtctgccccagaccttccctaactaatttgcttcacttctgcctgtgtttttatcctcaccacaagatgctgatcttagcttgggatcagctagaaagtctgacaggtggtgacccaggcttttgacttcttataatagagcttggcatgctatggcgcctcttggaagacctttcaaaggtctttctgaatggaaagcaaacgttcctgggcagtgtcttgacccagatgagtaaccaggtgccttcttcacctactgtgagctgattttaaggactatgttagctagcaagcatgtgctagcattgttcaaagtgtactatctcctttaaacctcctaagagccctttaaactagaggttttaatttccctattttgcaattgaggaaactaaggcacagagaggttaagcaaccttcccaggagcagtcagcgtgctaggctgagctggcccactccagagcctgtgctcctggactgtaccacactgctttcgatgcattacatattctccttcacagtaagcctagcaagtgggtaatggggcctggggtctctctgctctggagcccagcacttcatgtccttgctgtagtggttcctggtcagcctgcttgtggctgttgggtgtggctgccacacccatttgaaatatgtgtacattgtgaaatgattaaatcaggctaattaacttatcaatcacttcacatacttaagattttttagtgatgagagcatttaagaactattctcttagcaagtttcaagtatatgatacactgttattaactctagtcaccatgctgtacaacagatccccagaacttattcctcttatctcactgacattttataccctttgaccaacgtctcccatctatctgtcttcccccatcatctcctgacaagcatcattctactcttcctctgtgagttcaacttttttaggtcctacatatagtgagatcatagaatacaatgtttgtctttctgtgcctggcttatttcacttagcataatgtcctctaggttcatccatgttgctgcaattgaattttaacagctttttctctaagcccttttatttccagtgcccaataatcaaataagtataccccttgtatacttatttgattattggaatgaacatagaggtttatctgatctttataaaatgtaatggatcctgagctgggttggcagttggaggcaacaccaagacagataaccatctgcccccacagggcaaggaggtacagggtgacctcatatgtacctggaggatcagctggactgccctgcccacctcccagcctctgccttcctctttcatcagcactgtgggggcagctgtatctcaggtgggatgtggaggtcaaggaattagattggcctgaagcattcaataaaggaaggttctcttaaagtaagcttctgggttatttgaattttaaaagaaaacatttgtgaaccttaaatacatttccagttcgtgatggtatcaggctgcatgatgaaggggggaaattttgataggtgggatgcagatttggggtagattttaaccaccctgtacattgcaaaatgagacgattgcctactttctctgttgaaattaagcaaggtttagagttgctatgtttctgctgactgtgacatggcacactgggctgaaaagtgtcctagccagggtggcaggaaaacgaggctgcccttgaagctctaattgtttaccagcttttttctgcggatagatacctgaaatactctatgcctcaattccttcatgtataaaataacacactttgaataggacattggttccccaaactactcctcagaaaactagactagttaatagacgttcattaaaaaataagctctctgccggggcggggggtggggggtgtcactgttcaaataagtgtggggaaaatgctgacttaagcaaaaccaaagagatttcttcactgcagcacatttcagagcctttaatatgcttatgtgtattctgactcttaatgcacagtatttcccatggatgcctctgagtaagcttgatttgggagatgtgggacagaaccctttgctggtccaatccagccctgataaaagtattactcaaagacttgaagatttccccgaaagatgccatcgtctcaagatggctttatcttctcaccctcctcaccagaaacaccccaaattcttttcttcttccaagttcctgtagcatgcgtacacatgtcaatatgcacacaacacacacacacatccctctgttataaaagcagttattatgattacttctatatcaaatcaacaaatcgctatcagagacctcctgtgtcataggggttggggacctaaggataaatcagatgatgtccataaaatttacgcccttaaggagctcaaaatttagtaaaaagtatgtcatcttaacagttctactacatgttggcaatcataataactaatgaaagctatatgtggtatattaattcgtatcttgtccctacggcatagaagctatcggtctcattttagagatgaggaaagaaaaagtaacctgtccaaggtcatagacctaataagtggcaaagctgggacttgagcccaaatctgtcaaaatacaaagcccattcattgtccttacgaaataaggcctgtagccaccttagataggtagaggccaaaacaggagcagagaaggtggtttctaattgatctggtgtgaggagaggggatgggaggctttctaaaggaagtgaactgagacttcagtagtgaattgaaggaaaccaaggatgacagcaggagccaaggcactgaatgagaagcagcgtggtgcactagacacctattcatagtggcgctgtcaattgagctggaatgtcaaggggcaagtggtaggcaggcaccagatcatgggaaggcttgtagacttccccttctacccagaaccgatgcttctcattgctgctggagctcccactttacttcctccccaaaggttcgtcttagggttgttttgaagacagaattgggccctagttgccagtctggttggagactggaaagcttcaatgggatcaccttggatcagggagtccagggcattccacagctcgcacctgcccctcaggttgtgtgtcatccctgtctctctccattttttccttccttttttcttccagataagctgccctagttggaaggaaggattatggatgtcttattggttttcatggataatgcctgtgtagggttgatgcagtcatgtcacctggatcctcttcctgcgtctcacatgtgtgtggccttggttctaaggatggcacatcaacatcacaccatgctcactattcactaagtgactgaagccagcatttcttcacatgctcttagcagtctttatggggacttttattttaagaataacattaatgattttactaagagagctcaagaatttgagtattatgctagaactattaacaataatgtatataacagatactgttatctatgcctgccttgtagagcatgatgagtgggtgaatgagtgaacatgtaaaatagaaaacaaggaggacaattttcttatccataggaggctactcagtacttttttctctaagaaagaaattaatttagatgcaaaaacaaaaatgttctattatcaaggacaacgctcttttattaataacccctgtatccttttctacctgagtgaatgctatgtaaaatcttattatattctgctttgctacaataatacacttcttcaattatcattatttatagagacttataaatgaagatggtgcattaaaaggaagaattcctgcctcagtgatacagagttgggagcttatttgatacatttttttgccttcaaatgcaggatgaggaaatccttctttcctctaactaagtgtgctaattagttaaatgtgtttgaaaagtcaaattatagtttaggttgatttagccaatcttataccctttcacaaaaataaaactgcgatggtctttgagctgtcaggatacatactgtgtgtagctgaaggtattaatcacagatttggaggatatgtacacacatagatttgtttttaaaacattcattatcaagtgagaaatattggttaagatttagaagttggctgctaatgaacccagtggtttgcaaatagggttagccatagggtttttacctaagtcattgttttgttgttggctgtttgaattttttttctttttcctacaagaaaagagagcacaggctggctcttctctgctgtgagaaattctggaagaactctccacacctaccagattagtaattacagctctttcttgaacttaaattatttcaaaggccaaatggaaacaactctcacggtttttggacaaatatttggtcaggattcttggaaccatgggaaaaaccctactccatgccaggtaggacacaagattcagtatgagttggttcttcccagtcttgagtgggaatcaagatgaggctaagtgcttgttaatggttgaaggtgagccatattcttcacgttctctaaccctttcttgacagctagctacaagggcagatggtttaggctttgtggtaaggaggagaatttgtgtagaaagaaagggcatgatttgtaaattatggtgggagggagaattctggcttcctcctgtccccagaatccatgggacttggaagagtgagtactctgtactggaaatagctcaaaaggaagtagcagttttttgctgtgagctgggcttctctcaacacaaagcaatggaagaaacatttcatgaagaggttaaagatttcagagtggtttgtttacatttggctttcagacaatgtggtgaggggtgtcaggaagggcagaaaacccttaataatgtgggtaagcagggcagtgccaaagacattgggtggggtgggagaatgaactgatctcaaagcctcaaacagaatcttcatgccagccctctaaaatgatgacagagtggcccaaaacaccttccagtgggcactgccaataaaactcagttcaaatagtgcagaatatctccacgggtgcatagcaggcagcatctgctttataactgattactagtacttcttgtttctgaagatttggaaacatgaataaaagaaaggtaaatgcatcactccaaatacagaaatgactacctctatatagtgccaaggtaactctttttttgattaaaggatataaagcatatgcctcataatctaatgttagatttggaaccaggttattttgaatgtaagaacagacctggctgcaatttagttcacttagaactactatattgtttctgagtacattttacacttccgcatttttggaatatctctagggtaaaaattcctggaaaaaataaaatgaaaaatggcattctgaaacataagaagagtttaatgaaagacactaaaggcaaaaatttcttcagaccaccaccccctcccaataaataaaaaatgacaagctgtaactgaaatgtacctagtgttccattcctgcctgggagttccttgactcctttcccttctggctgtttgcacttgaaaatgccttcttgtcagttctcaagaaccttcagattgatggagaaagcaaacaagcacacagccaacaagctgaatagctcctagagtaaatacatcctttagaattgtgaatacagtcatgcatatgcataatgaccgcataatgacattttggtcaacagtggactgcgtgtccaacagtaatcccatacgattataatggctatactcaatagcctaggtgtatagtaggctataccatctgggcttgtataagtacactctatgatgttcacacaacaccaaaatcacctaacaatgcatttctcagagcgtatcctcgttgttaaatgatgtatgattgtatattactagacatacacaacaagacatcatttgcccttcaggaattgaagtattttgatgcaattgaactttaaatcaaattggggcaagacagcttttccctataactctagccttgccaaggggctccagaaagagaaatgaacttttttaaaaaacattgatttttatgcaaatagattcgcagttaagattgggtatgcatgaataactttctccctctaggtgtagaataaagtatcagtgtctatgaagtccaagagagatcatctctggctagttctctattattgacatttttaaaaccacctttaacctttagctgataaggcttaaagaaatattaatgtaaaaagcatatttatttacaaaacaaaatttaagctagtggctggatccttttggaggactcttttggagccagagttcctggctgcaagggacagaatgccagctcaaactagcttgggcaaagggagatttattggatggatattaaggcttctataataattaaaggaagagttaaaaactggccagaaatgcaagggttgaacacagttggggcttttttgactctctctcatcaccgtttctcttagccagcaagtttcattctcttcttcctcctccatgatgggaggaacatggcatacacatgtttctgcgtgtcacaccttgggggctcctgtaccagagaagactggtttatttttccattctcacttgaaaaatattcaggaagacttctaattggccagacttggtgaaaatgtccaacactgacccaaataacagtagccagtaggcttagccatgtaagaatgtgaaactcttcaatagttacacatgattggtgttagcagaagacccgttcccgtaagaagggggaagtatagagcagaatgcattgcgaatgccccctagaactttggttttattgtttcaaccttgtattttgatttgaaaagttgtaatggagtggtattcaatttttagagaagaaaataggtaacgttcctacttgtcaataggtaacatgtcagtgaggaacactgctgtcttctggtatttgcagaaatattcaccagagcaacctttagcttcattttgcatgcctaggctaatgaggttattcaaactctgtgttgttgttgtagtggtcatctgtggttttgctctcccagcatctagtcagtccttctgcttcagcttgaaacacctaggttttcctgtgggaaaccaatacctcccacattctcataccttgtgatttcaataaaaatgacacttttgctctggtttcagctacatgctagtgacgcagccctgggcaagtggaatggcacattactctggccaattcttggtccaaagatggacctccctcctttcttagagcttttcttgaaacattttgaaaagagacttctggagaatgcctttggaactgctggtggctgtagtttgggaggacctgatgagaataaaagtaaaagagagggcagagcaaagttgagggatgaaaattcctgaaaacaaggttaaaagtccagccatgtctaaactggatggttaggtgagacagtaaaatgcttccccttccttcccagttgcagttttagttacagcctatttgattgggatttctgtaccttacaaccaatgtgttcttaaaaatgctactatcttcatgagctgaactgtaatttctagttagctctttagctccacttccttgtgtttaggtatctgtagctgctttgcaagtcaccacagaccttggtggctggaagccagtaacaatcattttattttctctcatgatttctgtgggtcgggaatgtaagaagggctcagctaggcttttctggaagtttctgtgctgttgcaaggtaactgtggctatggaatagaagggaggagctgggattggagcccctgggggttggctgggcagctctcttttttatgaagtctcagtagctccttgtggactacttgggcttccttatagcatggcagtctcaaggcacttaggctgctaacatggtgtctcagagtttcagcacaattattccagagtaccaggtgtaagttgcatcatgctctatgacctagctttggaaatcacaaagcatcatttataccacactctggtcaactagttagtaaagttggcccagagtcaaaatgacaagatgtagacctcacatctcaatggagacatgtgaaagaattcgcaattgtatttatttatttatttatttgagatgaagtctcactctgtcacccaagctggagtgcgttggcgtgatctcggctcactgcaacctccgcctcccgggttcaagcagttctcctgcctcagcatctggagtagctgggattacaggtgcccgccgccatgcccagctaatttttgtgtttttagtagagatggggttttaccatgttggccagactggtctcaaactcctgacctcagttgatcctcctgcctcagcctcccaaagtgctgggattacaggcgtgagctgctgcacctagcccccagacaagtttttaaagcagggcatatcttgagcaattcccaaattgcatgaaaggtgcctgtggtcagcgtgatatatttaaagagacttagcttttgaaagacctacctttagtttatacttttggaaactgtattaactttttcaggcacctaagataccaccatattaaaaattaaatcaagattgattgtgatctttgaggcttcagaattccattctgctcttgtattaggcatttttaaatttctgtttgaatagcattgaaatatttagatttgtatttgtttgccactttataattgcgtatatactgacttagtcctgagattttgtaatttagtacttggttcttaagatagcttccaaagtgcttaattttcatctagtgaccagtttaagtggaagtatctcattttatagactgtacatgaaatagtaattaggatgtagacttgtaaaacttgacctggcttatggtcctagcactttgcctctgactgatgtagaaatcctcctttatattgtctagtaccatccacacagtgaaggttcagagtgcacctcttctcaactttctcccaagtggaggaagtccaatagatcttgaactaatttttttttttctgttttggaatgtagcaagtaatccattggaataaaaccagcagttgagtaactcatgcaaaggtaatttagagcacaaattaaatctgtcagagcggtattagatttgcaaaagctcataaataacaaatgaaaggtcacagaactgtgaaaatgagagtgtacttcttcataaagagaaccgtattcagggacacgatctgcagtgcatattcaaatagcagcatcataaaatggaaacacaatgtcttttctaaatgtctaatacagtacaaaggcactgcagattctgtggaaaagcatcaaagtcccaggaaagacttcatatcatctgaacatgtccagcgtcacatttgtgaggtttgtggattaaagctccatcaactactgagaatctatgaggaaaagatacatcccctgagcagtgtttgtatttcagtagctgttaggttaattgtgaatgcatgccactcatttttcatttttcagttcctagaaaatactaatagagtgagtggtgcttcatgatttactgcaggaatgtaaacagtcggtgatatgaataaacagtcctgcccatcctgtttttctcatggaaaagagaggtggaaaatacagccttgtctactataaagtagacaagttattttactgtgcattgtatgcattttttttagtcctgtgtcggttgtgatttttataagggaacaaaatctgtttataaaaaataatgtgtgggctctatcaaaattaaaaacttttgtagatcaaaggactccatcaagaaagtaaaagacaacaaagaatgggagaggatatttgcaaacatttatctgaaaaggatctagaatccagaatatagaactcttacaactcaaaaataattagataatattcaggcaaaatattgggcaaaggatttgaatagacatcactccaaagaagatatacaaatggctaataagcacatgaaaagatgttcaacatcactgattgcttgggaaatacaagtcaaaatcagcgtgagatatacttcacagccactaggatggctataatttttttaaaaaagaaaagaaaagtgttggtgaggatgtggggaaattgaaacacatatattgctgatgagaatgtaaaatggtgcagcttcagtgcaaaactggcagttcctccaaaagtaaaacgtaagaccacaagacccagcagttccactcctgcatatatacccaagaaaaacagaatgcatatgtccacacacaaacatgtacatgaatgttagcagcagtattcacaatagccaaaaagtgaaaatcacccaatgtctatcatctgataatggataaacatagtatgttcatacaataaaagaaacctcagatttctgtgccaggtgctttctttctgtttcctgatcagaggtccgtccacactgggttatggccctccattctggctgctgaagcgtaggggagggagggagttccttgtggagtgaagcttgatcagtggtgatcaagcaggaaggaaccaggtagatgacttgtctctttctccttccatgggctacaccaaggtgcaggccttcctcttaatcttctaccgttgtggtgtcatttgaggtggtgagcagcatagtaccctatgagcacgttgcctcctgttttctagatttatttccatctctcttttccccctttccctcattgtcttaggcttgcatcttccaaatagtgttaggacaccaggggagggcatggtaagagatgagaagagagaacattctgtttcatattgaatctattattttagaagacatgactattttgaggttatgttcattggttttaggtgaaaagctgactgacttgtgcataaaaagtaagtctgtcaaactcattctttgaaaaatgttattaaaagtttttctctataaaataatacatgctcattaagatgttttgaatatgtaaatgaatattaaaacactccttaagtcctacattattttggtgtctatcctttcagtccttttactaactacacataaacctagaaaagacatactcttttttttccaaagaagaaatgatttcacaagtaaaatgtattgtgagaattaaaattcaactactttaagaatttggaaattcagcattaaacacatgaaattcatggttaaaaaattatttgaatcccccaaatttgaaaacttgtgctaaagaaatcaggcctaatgaattcagcttgctctttcctgtgatgagtagaggtggatatcttgtaatgaatgaaatagttgcttaatttcatccacgctgatccaccatcctgtgcacacacaggacatggccttggaaggtgatacaaggcaatgtgctcctgacctccatcagcatcttttatacaagtaaaaattctttttctttggtatggagatattgccatacagtcaggaaagctgtgggggacttggtttagttcctggctgcaaagcaggaactttgattgttttctcatgaggcaccctgcttgttatgaggcatagcttcaagcagcaattgtagccatttggggtttttggccatttgggttttttagcttctatgagcagagtgctgtactccagtccctagttttatgctgtgagcctggttttagttccctatctcacatgaagacatgtaagactattctccacagaggccaagttcctgcagccacatccctgctactgggtccatttcccagcagccctatggcattttccccatgttgtatatgtactctgtgtctagtctgtaaaaatatccatctcctttttgacctgagccttggctttttggtattgtcctttaatatatcattagcattagtgtataattttatcagaaaggatgtggaatcatgatatattgtgaagacatctcccaccatttctttttattattattattatactttaaattctgggatacatgggtagaacgtgcagatttgttacataggtatacatgtgccatggtggtttgctgcacctgtcagcccgtcatctatgttaggcaccatggaggtaccatgatcactcttagttctgcacatagacatttgcaaaccaattagacgataaataagtagtatgatggagggaggggggaagcatgtttgacaatttaaacacactattaaaggcaacaaaacaaaaatggaaaatgctgcataaggttacatggaagagtaagttaaaaattgaagtgatgccacatagttttgtaagtcgttacttttttccaaaaagtaaccagaacaaaagttctgctatacttaatcctcatcgatttaaactttgccatgagtttgctttactgtgtactttactatgaatataatttttcatattcttgatattgtgaatttttaactatcccttcaagacatttctcactcccatctgctcatatttttggtcataaaagatatagtatacatgacttcaaattaagtctttttctatagcatggatctggatttttatttttagcagatgtgatgatgtttttatcactcatctcttatggcaaaacaaaggatgagttgacgaagaaagggagtggagggcaagaggccaaccctgaggtattagaatagtctgacataaatgttcccatccactcccacagaggctctcagaaccctctctgtggccagggtctgaggcagggaaagtaaggataatcacggcaagttcctgtcctgaggagctcatggtcctataacctgggaaggagtttacagtactctgtgtcacctcagatcaattatactcttttaaaattatgaaacatcatcatcactgggacatgtcttgtgggaggaaatgttacctaaaaaacaaaacaacaacaacagaaaacatgcagtgggctgaaatgtgtgcccccaaaattcatatgttgaagcctaacccctggtatcttggattgtgactatatttggagattgagcctttaaggaggtaattaaggctgaggccataaagctgagaccctaatccaatctgactgggttcttatgagtagaggaagtgacaccaggactatgcatgtagggcaaagccatcagcaagccaagaagagaggcctcaggagacagcagccttgccgacaccttgatcttggacttcctagcttccagaactgtgagaaatctctgttgtataagccccccagtctatggtattttgttacggcagcctgggctaactcatacaccatggatttactatcttaattttgtattttcctctccagtcttttgtctgtgcatttgttcacatttatgtttacagttacacacataatgttcattccattttgatctctgactctcaaactgagccctgctacgtacagattgggaggagatgggggtattggccatagtgctgccaggtatccatgggatgctgtgcagacctgtcccagaggtgcagcctcaccttaccaacctcaccatgctggcagagaaaagccagatggatgtggaaagaagcactgttgaattcattcaagatgaagtgatgtttgtctctgtcacttggctgctgacttgcaagggaaagatactggtggatacttgttttttcatcatgttgttcaaccaagtgcccagcacagtgcctggcagtcacatttattaagtgattgagtggcccattctcttcctgaatgccaggtttgcttggggaattaaattgtaaacagaagatggcgtagtgagcatgaaattagcaaggttggcattatcaagctgttacaagtgataagagagctctactctgttgtctaacaatttgccaattaaaaaagaataatcacatctggaagtaatttagcatgttatgcattttatggtttcagctatttaaaaaaatattttaaaaagttataatactattcacttaatgtggtcccattctgtaattttgaacaattgcttgcaccctataaacaattgggtctgttgggctccttagagtgttctactttgtaagttcatttttataccttctatcattgtgttttgattaattttgctttgtagtatattctagatctgattgggtcgtattgattttctgtactgagtttctgtttcataatatatttccttgcctatgtatttttacaaagtaattatgctatttaaaaaatcttgttgaacatttatattaaacaaaatatcaaaactgtttgttttcagctaggttaaaataaaatgagtaaccttgactccttgcagagcaatagagataatggtacttggaaaagtagtagaacatgaggaataagctttataggaaaccaagaagatagcaagagaatagcacctatataaaaattaagacagatctctgcattcccagtaagcagagcaattcaggcttattacagatttgtcttttccttaattttgagtgaaaaggacaatcagaataaaggacacagtagatagtaatcacttagtgctatagcgataacacaatcttatcagtttggttttttttttctgagatggagtttcactcttgttgcccaggctggagtgcaatggcacaaagtcagctcactgcaacctctgcctcccaggtttaagcgattctcctgcctcaccctcccgagagtagctgagattacaggtgcctgccaccacacccaactaattttttgtgtttttagtagagacagggtttcactgtattggccaggctggtctcgatctcccaacctcaggcgatccaggccttggcctcccaaagtgctgggattacaggcatgagccactacgcccatccaatccgttttttaaatacaccttaagtcagtcttaagaacaaagaattgcctagtgtttaactgtgcagactccaaagccacattgcctgggttagagtcagatctgctacttatttgctgaaccccagtttacccaaaatgggttaataattatgcctacctcatacggttgctgggagaataaatggatatacataaaggacttcagtagtacctggccaacaaatattagttacattaaggagattttgtgttacggaggcactttttaattttggagaggtcagctttcctgtatttgtttgttttcctaaatctgaaagtctgccctgtacaggtttgcatggacacccgtggcccagtatggctgaactccctatctgacctgcaccattctcagggaaatgcttctgagcttttgctcctgacttctttatcgtactctggcagccatcccctggcctcctagcaaaaaatagctggattttgttaaaattcagtctctcttgataccatctctgctggatatgagaggggatggctaccagtggagccttagcaacctgattaagactagatctgggctggaatgttctcagtgctctaaaattactgttgataaagtttctctccatgtctacccacttccttgtgccctgttgctctccatcccatcttaccagcatgggagctcagccaagcctcctgtggctttctccagtcgatcactgagatgattctttcttcatttttcaggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaagtaagactgttctctttgctgcagaaatatcactttatttcaaataagaagtggttcaaaaactggccaggaaaaggcatccttcagtatagtgaaaacctcccgtgatttaactggggtggtgcggtaatttacaaaagatgttttatgctttaccctcaccttttcacaagaagatttttggtggtgttaaggcaaattattgggcttgttttctctgttccctacacaatcactctgattctgaacactcttccccttgtactcatgccagtcctaagtcagcttttaaagtgaaccaccatatcccagaaggaggattgtttgtaaaagatcaatcctttatacgtaagataatagctggtcttcctctctgtgcatctaattctcaatttcagtgtaatttcctcccacaacttccaatgtcctgtgcctccttttggtttcctatatttaagaattatctagggaatgcttaataacatagatgcccagatccctgccctagagtttctgatttgcatgtatctcaggctgtacctgtgcatttttgcattcagcaagaacttcaagtacttctgctgcagacattctaaggatcacgctttaggaaacacagcagtttgacttcctcttttggtctctatctttgtatttattgtctctttgtatgaatcctcttctgtattgcccctgttgaggtgagagctggttgtattgtgtatattctgaccttcggcttttgccccaaggtgcattactcttttgaaatgctctgtttaacaaatatagtttgagtgtccactgtgtgtcaaggattgtgataggcttgaaagcataaaggcaaatcaaacacagtccttgcttttgaggatcacatagtctacaaagtgaaggcagccatgtggactccttcaatccacgtggttggaatatttaatgtctgcttgttctgggttagctgagaggtggtatgcagaatgccctggggcttggagtccacctgacctagggtcagcaactagctcagctgctttgtggccttttgacttaaaataaattccctatcattgtgaagattaaattaaaaatgtgtatgaagcacttagcactgagtgtgagacataggaaatgctcaatcaatgttaggagaattctttgtgttaattttgtcttttctaaagtggtaaagtaatataatacatactcgttagcattattttatggagcagaaataatatctgtaaaacactaggcctataccacaccaggcaatcaaatggttgtttacattattgtttttattatcgttggcttagtaaactgggggtgctgagaatacaatgctccagtgttgtataactcccatatacttttaataggcagcaaataatttctttagatttctattgtctctgtaccctcttatcagtatagtctggtgcccactggttaatcgtatggaagacttatctggctgcttgttttgtggggattttattttaataatatgcatgaagagaaggtgctttaatatttgttctgttttctagattgcattttgctgttttctccaagcaggcatgctactttattagacttggtgaatcaaaaacctaggtttctgtctcttagggttgattgccagagttttcagcttctgtatgattccttctcaacttcagtgacagactcagtagtaactgggctgcagaaaaggtccacactggacctacacggaggctgtgattgtacacacagagtgggaaggagaattaaggtgactggatttaacaacatacacaccacttctgcctcagtagtgtggtgggtcagtgccctgtgtgttgggtctctattgggaaattcaatttcagaaggaggtcttgaaggctgagccttgcaagcagagggaaatcacttctgctcttgaaaagttgatgaaaaagttctgctcatatgaccaatgttaattaagtaaagccatggcctgattagaagaaactcgccatatgtaaagaattagtagggcttcctcttcccctcactggcctgaggtgatctgtaaaaatggttcactattcatttgacctggaaaaccaaatcatgcaaatcagggttcaaatcttcatgttcactttaagaacacctgtgaaactgcccagaccatcaagcgtatgcatgtacaaaaagccactgagttgtctgaaagatgtcactttacaaaaataatgtctaccattctaacattacagtggtggagttggtagctgtgcccaggccaaacagtgaggctgaacacaggatcagtggcctgaaaagagtgctgatcttttgctgcacatgctttaaaacacagaatcatgctgtacttaggggtttagatgtagattccctggtcactgagcctatccaggtgaacaagtaatccaagatgcacggctgaacttacttaaagagccatacatgagctccccctgtcacatcgaggtgacccttactgaaaagaatcaaattgttcctaaaccagaagagggggttgcagagaagaaaaagatatcccggaagaaactgaagaaacaaaaacgtatgacattggaaataaatgcagcataaaacaaatgcaaataaaagtaaaagaaaaaagaattggtgaggttttctgatatgattttgagatatggagaaggatggaagttgttcctaagtgagattataagtagatgattcaccagcagatcagggtccaagttctctttagagtctccctccataacttatgatgggaatactgtgtaaattgttgttagagtgaagttactatgaatggctcctacttggccagaacttcgtttattctgtccacctttttttttttttttttttttttttgagacagagtctcactctgtcgcccaggctggagtgcagtggtgcgatcttggctcactgcaagctccgcctcctgggttcatgccattctcctgcctcagcctcccgagaagctgggactacaggtgcccaccaccaggcctgactaattttttttttttgtatttttagtagagacgggtttcaccgtgttagccaggatggtctccatctcctgaccttgtgatctgcccgcctcggcctcccaaagtgttgggattacaggcgtgagccaccgcgcctggcctattctgtccacttttaaatcagtattaacttctaatttctttgaactattttagaagtttgtggtgtgtgttttcacactttgattttttaaatggcgtggttctatgtccttgagcactagaccatattaagctgtagtctctacaaataagcaggtatctgttgaacatagaccgtaaaaaatatatgagggaagtatgggattagtttgattttgaattatttgtatagtcacctcactttgtagatgaaggcacaaacagcattcttttgtgaatgagccacatttcattaatgttacaatgtgtaacatgaagctcggaacctgctgaaggagaaatatggtgatgctggagatatgagaagacacacacattttctgtaccagacaaacagaagctattttctcctcattccgatgcccagaacagccatcactgataataactggggagagattggaacaccaggctgggaaaattcagcctctcatgactcatcttttttgctccctggtttcctaatctttgaagtttctgaacatttaaaagaaagaaacttcatggctttcaaacctgaagcactgtcgtcaataatgttcttttctataatccttgtgtcatttgttgttgagtttttctttgcttgtttttatgtgaaaaatgaatttcttcccagcctatgattcaaataccaaatcaaataagaactttcaaaacaagagttactattaagagaaatagagctgcttatttggtagtcagacatagtaagagatagcagagtttaatatactaagtggctgcgacctattcttagcctccatttctttccttagaatagaaagaaacctttcctaagaatatccaattttcctctggttgcatgttttgaatctttccttaatcatgtacaccaaagagctgtattcctgtgggggcttgtttgtgcccatgtagagagccaaataagtttgttcagactatactacgtaagtcttagagagtaaggggactttctaggaaggtaccagataatgtatttatttctgtcagaaatatgtgcatattaaaattatacttaaatattttgttgccaagtggactgagaaaaaagatacatttattagatttctagaatttttatatatgcatccagttttcagaaacaatggaagttaatttggtaaggatagaaaaatgtttggatgcattacacatcagcatacctttcaaaacaaaagtctgttctcaccacggttctggtaactgaaggcctttgtctaggcaaaagttccaagagatggaaacaaagactaaatcttttctgataccgtacaaataaattatggtcggttgaactatggctgaccatgagagttaatggacagattattttacaggaagtaactgggcactttggcgtttctttttttctttacaatcaccttctcttaagggaccaaggacttatgccctgaaatacagagtactgagcttattaactctgtgatcaagagccaaattagattcattcacagctggggccacaacaatttgaaactccgcttgctctacaatgctttgaagtaacaaagaagcaaatagcacatctcttaggaacctctttccgtcctttaaaaaaaaaaaaaaaacctctttatcagatgcagtatcaattagcaagttactggagatagttgttcatctgtagacctcatttctggcaaaatatctcaagagggaagaatttaaccatttacttggtattataccttaattatccactgaaagcagtatgtttgcagagatttgtcattaatcagggtgtgattattcactaattggtatttcctgccaagatgtcagtaaaggttcctacaagcaaatattaaactctagccattgagaatgtgcacagatatggagctgtagattctaaaagaaaactcaccaaaaatgagataatttggttgtcaacgatacgtgctgataaactcagaggtaaaagaatttaagcaaagcttcattttgctgccatagtattttagttcccactcctgtttaaatttcaatatactttgggttcattttcagaatccaggcctcttatgtaagaaataagtgtttatagtatgtcacttgtctcacaaaagatcattttgaaaagtctattaagtaattcaaatttgtgaacactacaacttactagtgttagggtctcaataagtttgttcttggagtagctggatcgtcaatcttcattcagaattcttaatttatctctttgatgggaaagtttccaggaataactaattcagtattccatccaaaaattttactggctgcagtgacagacagataaaattggatgccccagtgaattaatcatgcaaactgaagtggtacgagtagcttgcagccataaaccttggtgaatatgatgatcacttttttgagaaatgctgttctctgacaaatgctttgtatctttttttttccaaaatgtctactttgatcattccacttcaaattttacaagctattttaaagtccaatctttgaaagttgtttatatattaagtattttaaacttgatagggaaactattttttaatgtatccagtcaggacaatttcctaaaatattttatatgattaattaaaatatctgcaagagtattgcatggctttggcgtttgagaacctgttttgtttttgtttttttaattcttcagccatgtacaggaataccttagagattattgcaggatcagttccagaccaccacaacaaagcaattatcacaataaagcaagttatgcaaattttttggtctccttgtgcatataaaagttatgtttgtattataccatagtttattaagtgtggaatagcattatgtctaaaaaacaatgtgcatatctttttttttttttttttttttgaggcagggcttggctctgtggcccaggctggagtgcagtggtgcaatctcagtttactgcagccaccgccacctgggctcaagcgatcctcccacctcagcctcctgagtagctgggaccacaggtgtgcgccaccacgcctggctaatttttgtatttttagtagagacaggatttcttcatgttgctaaggctggtctcgaacttgtgagctctagctatccacctgactcggcctcccaaagtgctgagattacatcgttggccaccatgttccaccaacaatgtacgtatcttaatttaaaaagacttcattgctaaaaatgctaagatcatctgagcctttagtgagttacaatctttttgctggtggagggtcttgccttgatattgatggctgttgaatgatcagggtgatggttgctgaaggctggggtagctgtggcaatttttaaaaataagacaacaatgaagtttaccatatgagctgattctgcccttcacaaaagatttctcagtagcatgtgatgctgtttgacagcattctactcacagcagaacttctttcaaacttggaattaatcttctcaaaaccctgccactgctttatcaacagttctatgatgttctaaatccttttttgtcatttcaacaatgttcacagcatcttcaccaggagtagattccatctcaagaaacggcttttttttttgctcgttcataagaagccaactcctcattcacttaacttctattatgagattacagcagttcagtcaccttttcaggctccgcttctaattctagttctcttgctgtgtccaccacatctgcagttactttctctgttgaaatcaaagtcatctgtgatggttggaatcgtgtatttctaaactgctgttgatgttgacattttgaccacctgtgaatcacaaatgttcttaatggcacctagatgattaatcctttctagaagggtttttaatttactttgctcatattcatcagcggaatcatgatctatggcagctataggcttacaaatatatttcttaaacaataaaacttgaaactcaaaatgacttcttgatccatcaactacaggagggatgttgggttcccaggcatgaaaacgacattaatttccttgtagatctcctacagctcttgagtgaccagctgtattgccaatgagcagtagtattttgaaagaaatattttttttctgagcagtagatcccaaaaggggcttacaatattcagtagacaattctgtaaataaatgtgctgtcatccaggctttgttgttccatttatagagcacagagtagacttaacataatttttaaagtctcaaggattttaagaatgataaattagcattggcttcaatttaaaattcaccagctgtattagcacctaacaaaagaatcagcctgtcctttgaagccaggcattgacttttctctctagctatgaaagtcctagatgtcatcttcttccaatataaagctgttttgtctacactgaaaatctgtttagtgtcatcatcttcagtgatcgtaactagattttctggataacttgctgcaacttcttcattagcactttccattataccttatgattttatgttatggaaatggattttttccttaaaccttgtgaaccattctctgctagctgcagacttttcttctgcagcttcatgtctctcagcctttatagaactaataagagttaggaccttgacttggattaggctttggtttaagggaatgctgtggctggtttgatcttctatccagaccactcaaactttctctgtatcagcaaaaaggctgttctacattcttaacattcgtgtattcattaaagtagcacttttaacttccttcaagaacctttcctttatatttacaacttggctaactggcacaagaggcctagctctcagcctatctcagctttcaacatgccttcctcaccagtcttaatcatttctaggttttgatttaaagtgaaaattgtgttactcttcctttcatcttaacacttagaggcatttgtagggatactagttggcctaatttcagtattgttgtatctcaggaaatatggaggtctggggcagggaaagggagagagagagagatggaagaatagcaggtggatggagcagtcaaaacatacacatttattcagttcaccattttatgtgggtgcagtttgtggtgcccccaaacaattataatagtatttcagagattactgatcacaagtcaccatacagatacaaaagtaatggaaaagtttgacatattgcaagcattcccaaaatgtgacacagacatgaagtgagcacgtgcaattggaaaatgacaccgatagacttgctcaatgcagggttgccacaaaacttcaatttgtaaaaatacaatatctgcaaagtgtgctaaaatgaatggtgatacaacaaggtacacctgcccttaccaaaatagaacctttcaattcaaatgtaacccatttttctataggtgggtaatgtgaaggtataaaaaatatttgtttatagtttacaaaatacttctctttgtcacaattatatgacattttccccctattaaaatttcctcatgaaaatggagtggttggatggctgtgtctaagctgctttccatcattttgtaaaatgatctatgcactttttctatcattctgtttatgaatttgagttactatgtgagagagagcacgcagatgggcccataaaaagttccgattacttgtcttttttagactgtttatgacttttgatcatgacacattatttgatattgtcatagtcaggtctgtgaagtaatgcaagcatgtacatggatgggcagctattctcggcaaggtgaaaatcaaagtgatatctggtccatcattctggccttaagctactgccttctccttcatttatttttgataacatatctaattggttccatgtgggcagagcaatttaccctgagatgattatttccgccagtgggatatgcaggctcagccatctgcgagagagaacagttggctcctgcagatgaagtgtttgagtgtttgcagctttcaaataggccaggtaattttacaaattaaacagcacaagttttgtttatgaaaggcaaaactctaagtagtgaagcaagcaaatgattagagctaagaagcaattaaatgcacatcagtagtaaggacaaagaacagctgggcctgacattcctcggtgatcctcatctttttgtggagagaaggccttgggtgcccgcgacagcctccagagctcaaatctcatgtgacccctcctcacctgagcatataggtgaagaatcaaagcacttggaggacagttccttctgaaggcaggaagaggcaactcaccagtgggagcagtaggaagagataagtggggcttcctggaatggcctagtcctcaggctagaactggtagcctctggtgcctcatccccacatccccccagcatctagcttctatggacatgggtccgaaaggcacctgaagagggtcacctctgcatgggcagcatatattttagcaatgaagactcttctcttagctaaggcttaccatctccaggggttcataatgacatcaggtctgaacagataaaaattttacaatgtaccagagaaattgccacttttgtagattgaaatggtcaaacatcaggaaattttatgatgattcaacccaatatttttatttgcatgttgacatttgtgtataagttgacatgagtaagttattagaaatccagagaatgcctttttaattaaaatttttattgagataattttaaagtcatatgcaattttaggacatagtacatgatgctgagtgtggtagttcatgcctataatcccagcagtttgggaggccgaggctggaaaatcccttgaggccaggagtttgagaaataatacagtgagatcccatgtacccattatccagtttgtcccagtggtgacattttgaaaaactatagcataggccgggtgtggtggctcatacctgtaatcccagcactttgggaggccaaggtgggtggatcacctgaggtcaggagttcaagaccagcctggccaacatggtaaaactccatctctactaaaaatacaaaattagccgggtatagtggcacatgcctgtaatcccagctacttgggaggctgaggcaggagaatcacttgaacccaggagatggaggttgccatgagctgagattgtgccactgcactccagtctgggcaacgagagtgaaactcagaaaaaaagaaaagaaagaaagaaaagaaaaactatagcataataccacaactagtatattaatatcaatacaatcggtctaccaatgtcattctgatttccctaattttactctgtgtgtgtacatttagttctacctaattttatcatgtgtaggtttgtgtatcctccaccagagttgagacactgaagaatttcagtaacacaagggttcctcctactggcctcaaacccacctctctccccacctctccacccctacccccacctctgccatccctaacccctgacaaccactaatcatttcaaaaatgtcatataaatggaaccatgcaatatataacgttttgggatgggctttattcactccaaataatttcctggaaactcacccaagttgttgaaagtagtaatagttcattcctttttattgctgactaatgttccatagtatggatgtccaacagtttgtttaaccattcacccactgaaggacatcgaggatatttccagtttttgggctattacaaataaagttgctgttgacatttgtgtacagatttttgcatgtatacaaatgttcatttctcagggacagatgcccaagagtaaagttgctgggtcatatggtagttgaaggtttaagaaactgctaagttgtcttgagaatcctttctttaaaataatgaaaatgtcttaacttcacaggattctgtgccttgtctaaaaattaatcttttctcttaatccttttttttagccacaccatatcctggtggatttaaatgtttcacctgtgaaaaggcagcagacaattatgagtgcaaccgatgggctccagacatctactgccctcgaggtaaactctcagtagactgattggggtcccctgggctgtccgtgagtgaacagcccttttgactttggtgatgtataaagagaggcatgcttgcaatctcagctgctcctcttgtctaaggctattagatcttttgtaccacaccaataacttatcagagattctcagagacataaactgagccataggattgtttcctttctcatgaagtatttttggcactccacaggaggtgataccttcgcctgtacccccgggcccagtcaaatgtaggaaaagagaacagccagtctgtctgccactctgaggcattagtcagtgcatagtaacctcttttatgtaatgtatgaattgatgttcatataaagattccattgattacatatcttgccagagactttcatgcagtctctagaatttagaattctgaatgtcatcattgcacaaataaaatccctgagatttttaaactattaagttttttttgaaggatgagatgaacactgaactgaagcatggaattttgaccgaaaggcccatttcaaaataaatacccattatattcatgtctcttttatcctatcaaaaagaaatagatggttatatttggctacagagtcactgttaactggctattttactttggaggaaagtctatttatttggtgggggtagagataatgagcacagggaattttattgacaaatgttcgagtgaatagttagatgggtttcactgctgatctaattcagttgttaaaatggcttggacacaaccacaccaaatccattatttttcagtataacacgagtattatataagagttctcatacttaacccagtgaatggtattctgcctcttgtggaggattggaaattgggagagcatggaaaccaaaattaaaggaaacatgtcaactatccaagctagtactctaacccaggagcctccactccacctagtgtgtccagtagaaacacctgtggaatttttcaaagaaatcactgaaagccttgccctgtctagaccagtggttttcaagcttcagcagcagcatcattctccagagggcttattaaaacatagatttctgctcccacccacttcttcacccacatttctgattcagtgggtctgagatagggcctgagaatttgcatttctaaagggttgtcaggtgatgagttaagaatcacagctctacacaaattgagccagcatttctgagattagggccctgcattggtactttaaatattgcagatgattctaatgaaaagtcaggggtaagaaccacagggagctcctctacataagaaacagaaatgtagtgttgtcatttctaggctcttcttgttgacttttaggtagagatgataatagggcctacagggcagagaaaaacatggaagcactaaagattggcttaactgaaaactagatatccagccgtctgagtaatcgaaaataagttttattgccgtctgtagtcactgctcatttccaaatgggccagtattttctaacattaccactgtggaatgaacattgctaatggatctgattaaaccactgcttctcagacttggctgtctattgaaattacctggtaaactttcgaaaacactaacacctagatttgttcccagcgattcatattaaatggtccagctaggcataaggatttttaaaagccctccagatggttctaatatgcaaccaaatttaagaaccatcatgaacagtgacttcaggcaaaaccaagatgatttgctttgtatatctagtcatctttgggctagttcctgtggtgataaagctggctgatttgcttttgaagctgttgccctgttggtcagagctagtatataggaagcgtgttttagtccacttgtgatgctgtcataaaatacctcacactgggtaatatataaacaatagaagttatttctcgcagttcttgaggctgggaagtcccagatcaaggtgccggcaggttctagaagggcatagactctctgctttcaaggtgacaccttgctgctgcatcctctggaggggaggaacactgtggcctcacgtggcagaagacaaaaggcggggaagggaacagacccactccctcaaacccttttataagggtcctaatcccattcttgagggctccagactcatgacttaatcaccccttaaatgccccacctcttaatatcctcacattggtgattaagttgcatatgaactctgggggacacattcggaccatagcaaaatgtgactgcttctcctggtactgactgagctttgaggtaaccttagtggagataatgcagaggaaaaaggaatgtgaactggtattctgtgtaggctctgggccacgtttgatggtatacaagtatatccctgtcaaaaagaaaaagcaagggaccagaaacactgcttgaatgcctcacagagaaaagaggaagttccatcttgatactttcttttgaggtcataatctatcatttcaaagtccagatacctaaaggtattgcagagtggtctctacacaatttatccttttctcttttttcccctctacttttatctttctgtccttcaatttaaagggataaatagaaagtcatgcactgaggttcagaacacaaaacaaccatgctaggccccttggggaattacaaagtgaaagataggaatctggtttcttctttcagggagcaggcggtttagttgggctgataggatctgaacatatcagatgtcaaaattagcaggacaaaggtaagtgccaagtggaacctggcattaagcactgtgggagtttacaggaagaagagctactggggactgaggtagccagcaaaagcatcacgtgctgagaagattgcagtagctctacaacttggaactggaggtccagcattgaagagaacatgtcttccaggaactcactcagagcaaaggcatagagacaagactccccaggtgtgctcagtggatggggagagagctgacctgggagtagcaactagtttgtatgagagaattagggacccaaaatagtggagccaggtgatttttgtggggccttgagcatcaggtaaggagtgggaacttaaagctgtaagctgagaaggggtgaggccacactcagcttcctgcttggccagccctatttcccacgagtcttctgctctttcctccaggttttcttcagatttttctaacaatgaaaataatgccattttattaataaattaaaatagaaaatgtatttcactagtagctaactctagatttttctgttagtagtctgaagcagctctaggactaccaatgggcttaggaagggcaactgagacactgctatggaaattctaagacattcctgggtttttttggtttgctttgtgacatagttaactgggtttaaattatcacctgatgtgaaaataatttgttgaaagtgaaaaaaatcacctcatctaagtattcaatcttataaacgcagaataagtgcacaccccaaattgcttaggggattcactgaatgtcaagaattttctaaagctaacctcagtcacatgcatgtgcatagagacatagtgtatcttagcgactgacattcagggattcagacttgttttgagttattgtttggccaagtaagtgtcaggaaagctttctcctgactggaatcactcttttggcagtggcggcatcagctggacacacctctagctaactcaggttccctgtctctcttcttttcagaaggtgtgtgatataagggcgttctcctccattacattatttgtgcctctggtgcttccagattcatagtactatactcccttcctagaaatgggagcttaagatgctctccataactgactctggttgctttacttgcttggcttccatttcatctttgatctctgagcacttcctttgcaacaactttaatttcatcagctactcattataaatctgttcaattttcttgattttgtgaaccagaatggaaaaggatcttgaaatcacattacgttaggagccaattgaaggaactgatgatctaaaacaagagttgaatgtcgtgtgcttggatctacgtttgcccatgacttttctctgtgctgcaagatgaaaagatcctagagagagggactgtaaaaatggttattaaaagtctatggaattaaatgtgaagtcaaagacattccagtttttaaaaaggcttgttttgtggaggatagctaagccaaagacattatgttcctccttaattatgaagtacagatgcctccctctaaggcaaaatctccatttgaaaatactgctgatatataatcagaaaaagaaaattattgagttagaggacacatattcttttggctccagcttctatgctcttcactgtttttctgtaaaagtaaagaaaaagctggacatatcccttgatggctttttccagattggttgcctgatggttcttgctacaagcaggaaatgtaaatgtgatcctcagctcaactgaagacaagaccatagttacaaattttcaggaacgatttctttattgttgacttttttcagacatagcccaggctgaaacagacaacctttgtgtttgacttaacctaagggtggaattttcttccttttaggcaattttacagttagaatatagccctccaattttttttcatttatacaggagtctctgttgtctctctgaatcccatggggacccaacgccttgcaatttattatggcttatcttttaacattgttctttccctaggatagagaaatcaataccttatccagtgttggcccttgacactttcctttctggagaattcatttgtaatttacaaaaagtgctggttacattttatccaacacttctggctgctatgtaataagatgtttttcagatgatctctcatcatattattgtcatattgctaagtgaaagtcttagacatcctcctttttaaaagtaattttaaagttgaatatacataccgcaaagtgaagagatcataagtgcacaatttgtgaatgtttacaaagtgaacatgctgtgtttccacccatatgaagcaatagaaccccagaggctgctagggtgccccagtcattatactccatccccaaaggtaacaatgttgagactgttatcattgagcatcacatatgtggagttgtatagaatgtactccttgctttcaaacattatgtatgtggcattcctccatgtcttttcgagcaacaaagtcatgttttctcagggatgtatagtagatcattatatgaatataccaaaattcatctattccactattgaaggacatttgggttgtttccagtttcttaatactatgaacattcttctgtatgtcttgtggtacgtgttcatatgcgtttctgctaggtctttctcagaagtgggattgctaggcatggggcatgtaagcattggctttactagatactgcctgaccgtttgcaaaatgatggtaccacttacaatctcaccagcagtgcatggaagtgctagttgctgcacaatcttgccaacacctagtattgacagaaacaatagaaggtagaagttaaccagatgacatttttaaagtgctgaaagtaaataactggcatcctggaattctatgtggagaccatcagtctcgcttctctgaacctcatttctcctgcggctgccctgctagctctgatctcctgtttgtgctcccagtccccttgagaccgatgaaggtgctgccctacttctctgccccttagcagagctttctgcttggtttctcagcctctccacctgtgcaatttttgaatcagcaaatgcctcgaggggagaacaggtatagaatgtcaggcaccactcagggggcttgtcttttctctggtaccttgctctttaaatccagtctacaatggcaggcctgtgctttcacacagatttttgttgtttacattttaattggctattttaattttattctgtttcttggtaagccatcccatttcagctggcattataattctcggaattagtcttagaacttttctagcaagtttttttttttttttttttgagacagagtcttgctgtattgcccaggctagagtgcagtggcacgatctcagctcactgcaagctccgcctcctgggttcacgccattcttctgcctcagcctcccgagtagctgggactacaggcgcccaccaccacacccaactaattttgtgtatttttagtagagacagtatttcaccatgttagccaggatggtctcaatctcctgacctcgtgatccacccacctcggccttccaaagtgctgggattataggtgtgagccaccacgcctggcctccagcaagtttttaaccttaagtcctatcagcccatacaagactttttttcgtacactgagagcatctaaccttctccaattcacaatattttgtccaaatatgttttacaaatccagttgcctcagctgggatgcttccatttgatggtctgccttatcacttttatcctgaccactgttcaccataaagtcctgtctatcctcactacctttgcataccttcccagctgcctttttggaattggccttggtaataagtacattgccttctgaatttcagtgattagttttaaaagaagttcctccagtgagaggttcattaagaaatgtggatgaatattttttagaagaaaatagggaagtctccatttggcagcttcctcaaaaggtgctgacttcagggtagaggagactaaccagttgtgattcagtcagtttgatgagcatttatttgtttttaatttctgccttgaggaattttttacttggaacaagaggagaaaacacatctttttaaaagatctatggagaataattgttaagagcagaaaagccaaaacaataatctggtgcctgaaagcggagactgtagtaattactaattagggtaagtttaaaataattcagtttatctgcaactcaatttgtagttcatccttttcttgagtctattttctttcatcttgggctctttttttctttcgctttcaattttactgaactttgaagtataatgtacataccaaatagtaaatagcatgatggactttcacaaattgaatactccatgtaagcagcaccctgattaagaaatgaccagcatcttagaagctcctcgcatgcctgttttcagtcacttttcctaccaccaagggtcgctgttatagactgacttgtgtcctccccatttttccccctacctgctctcaaattcttatgttgaagtcttaacctttagtacctcagaatgagaccatatttggaaatagtttttagagaggtaattaagtgaggtcattcaggtgggccctgatccagtctgacaagcatccttataagaagagattggaacacagacaggaactgagggaagctgttgtgaagacacaaggaaaagactgcccaaaaagagaggcctcagaagaaaccagccttggccaacaccttgattttcaatttctagcctccaggactgtgagaaaacctttgtttaagcattcattcggtggttttttatggcaaccctggaaactaatatagttaccctcctaatttccagtagtgtaggttaattttgtcttactgggttctttgtagaagtggaatcatgcagtataactcttttgtatctgacttctttcactcaatattatgtgagattcatccatttcgttagatttagttgtaatccgttcattctcattgttatgggaacagatactataatttattcattctgtcgctaattgacatttttacagcgtgtttgtacaaatagttcttctatgcacgttctaggacttatcattcttgttggatgtatattgaggaatagaattttagcttcatagaatatgcataggtttacttttagtagtcctggcaaataattttgagaagtcatgatagtatatgaaaattgcactactggtagaagtgtagtattatttctcttttaaatttgatgagactattcaaattcaatggaagatatgttatagacgtcgtagaactaaattaaaatgttttaatttggttcaactttgaatggaagagcttagctagatatattcttcctacccatccatctctgctggtaatacaagagtttattagagattaaatgcctgctattgtgtgcaatgccctgtgttatatgttggagggaatgcagacaccaacaagaatgggcctgattctcaagattataatgtataatacaacagtagatctcaaccaggagcaattccctcttccctgcccgaagtatatttgtcaatgactggagacattcttagttgttactattggcagtgacattggcatctagtgagaagaggctgttggatgctttaaatgtcctacaattcacagagcagtctgcccaaaacaaaattatctagcccaaaatgtcagaagctgaaaactcccatttctggaaagatggaatggatgtacttttctattcctcctgctaagtatgacaaaaaattctgaacattatttattaaaaagcaaaccaaagacatgaagggactctgaaaggtgtaaagaaaatgacagactagggacttcaagactcaaggaacaacacagtgctgagttcactaggttttctttcagtctcatatattctagacttgaagctaaagaagtcaacatcctgcaaatgccataggcactggcaaaataaccccccaacagaagtttgctctctagcagaaggaccaggaagggggaagcctagaaagataacttttagacaatagctgctctactgcagcaaaacactatggaaaaaattgtagccccaatcccataccagcagaggctgaatggaaagccttgacttcatcctcaataggctgtaatgagatgtcccaacctttctgcttgggattgtgtcagagaaggacaagtaaaggtgacacttgtccctccccaccaggcagtaacaaggtctcttccacagtgtcaatggagaccgtgttagggagcctagactttcacctccaccagcaacaatgagatgcctctactttcccctgaccaaggttgtgtcaaaggaggcttaatggagagtcaagacttcacccttcaccgccacccattggtattgaggctacaacacatctcccatcccatggcattagtagaggctacatgggaagcattaatgaggcactcttaccactctcaaacagggagtataagatcaagagtgtcctaacataataacaatatgtccaggcttcaataaaaaaaaccacttgtcataccaggaagatctcaaactgaatgaaaaatagcaatcaatagacaccaacaccaagataaatacagatgttagaattatctggcagggattttaaagcagccataataaaaatgtttcagtaagtaataacaaacacacttgaaacaaatttttaaaatctcatcaaagatatagaaaatataaaggagaaccaaatggaaattgtacaattgtaacataatgtacctgaaataaaaatctcaatagatgggctcaacagcagaatggaaggaacaaagggaagaattagtgatgaatttggaaaacagagcaataaaaattatccaatctgaacaacaggtagaaaataggctgaggggaaagaaacctctacagagcctcagagatctatggagctgtaacaaatgttttaacactacatcatcagagtttcaagagaacaagagaaagagggtgaagctgaaaaaagtactcaaagaattagcagctaaaagtttttctaagaagctgagcaaaccccaaagaggacaaaactaaagcaatccacacaaaaacacataataataaaacttctaaaaacaaaacgtcttgaaatagcaagagaaaaagaacatctgatatgagaaacattagttgaatgaaacgttttcatcagaaactatggaggccagaagtcaatggtacaatattttccaactgttaaaaaaagctatcaatgctgaatcttatattcagagaaaatatccttcaggaatgtgaagaaattaagacattttcaggggaaggaaaactgagagaatttgtcactagcagacctaccttaaaagaatggctgaaggaagctctatatgcagaaaggaaatgataaaagaaggaaacttgaaacatcagaaaggaagaaaaaacttagtaaacgtacttgatactacaatgcagtacaacagaatgtccttcttctcttgagttttctgaattatgtttgacagttgaagcaaaacttataatgctgtctgatgtggttctaaatatattgtagaggattatttaatacaattatattacggccaggcacagtggcttatgccagtaatcccagcactttgggagaccaaggcaggtggatcacctgaggtcaggagttcaagaccagcctgatcaggttgatgaaaccccatctctactaaaaatacaaaaattagccaggcttggtggcaggcacctgtagtcccagctactcgggaggctgaggcaggagaatcgcttgaatctgggaggcggaggttacagtgagccaagatcacaccactgcactctagcctgggtgacagagtaagactttgtctcaaaaaaaaaaaaaaaattattacaaacaagtgaaggtattagggcataaaaagaggtaagttttgtacacttcactttaattggtaaaattatgatgccagcaggatgtgataagttttgcatataatttaatacctagcgcaacaattttaaaaagagatatactcaaaagcactgtagataaatcacaatggaattctaaaaaacattgatgtaacccataggaatgtaagaaaaaacaaaaacaagacagaaaataacaaaatttgtcttaccatatcaataactaccttaaatgtaaatggcataaatatacaaaataaatgaaatgtattgacagaatatgttaaaccatgacccaaatatatgtcatctgtaataaatttacttcaaaataattatataagcaaattaaaagaatggaaaaagatagtagggaaacattaatcaaaagacttcagtgcagataaaattaccagaggcagagaggaacattatagcatgattaaaaagaagcccatccactaagaagatatagcaatcttaagtatataagcatcacataacagagctgaaaaatatgtgcaacagaataatataaaggaaaggaggaatagataaatctacaattatagttggagacttcaacaccactctttcaaaaactgatagaactacagaaagaaaatcagcaaagatatagaagaattcaacagcaccattaaccaacagaatctaattgacatttacagaacactccatccagcaacaccagaatatacatggttttcaagtgaccatggaacacataccaaaataaactatatcctgagccataaagcaaacctcaacaaacttttaaaaattgaaatcatacagagtgttttctgacacaatagaattaaactagagatcaatgacagaaagataaaaggaaggtcaccaaacacttggaaactaaacagtgcacatctaaataatccacagatcaaagataaagtcttaagggaaatttaaaagacaatgaactgaatgaaattaaaacatatgaaaatttgtaggacacagcaaaaacaatgctgaggccgaaatttatagcactatatgcacatatttaaaaacaggaaaatcaattctctaagctcacacatcaagaagatgaaaaaggaagagaaaaacaaaccaaaagtcaaacaaagcaagactaagcaaaaatcaggaaataataatgataagaataaaactcaatgagaatacatatactaaaacatttcattgtacaccataaacatatacaatttttttcaattaaaatcaatggagaaaaacattaaggtactaagaaaaggaaaataagggaatagtatgaacaactcaaaaacataagtttgacaagttagatgaaatggaccataactcaaaaaacaaagtaccacaattcactaaaaatgagataaatagtcctataactcctaagaattttttttataacttaaaaacactcataaaagaactcttcaggcccaaataatttcactggagaattttaccaagttttaatagaggaattaacaccaattctagataaaatcttccagaaaatggaagagaagggggaatactcaattcattttatcaagctggagttaccctgataccaaaaccagaccaacacagcaccaaacaaacaaacaaacaaatacaaaattccaatctattatttttttatgaatatagacactaaagttcttaacaaaatattggcaaatagaatgtagcaatatatgaaaagaattatgcaccatgacaaagtggggcttagtccatggatacaaggctggtttaatctctgaaaatcaaccaatataatccacagtgttaataggctaaagatgaaaaatcacatgttcatatcaaccaatgtaaaacaattgtcaaaattaaacaccatttatgattaaaacctctcagaaaaataggaatagcgagaaacttcttcaacttgataacatcgattaaaaacctaccactaacattatgcttaatggtaaaagactgcatgcattcctgctaagacagagaactaggcaattatgtctgctttcactacttttatttagtgcaaccctgtagattctagcatgtgcaataagacaagaaaagtaaataaaagacatacagattggaaaggaaaatatgactgtcctttttcacagacaacatgatttctatgtagaaaattccaacaaatctaaagagaattcctggaactaataaatgagttcagcaaggtcataggatatacgataaattgagaactcaattgtgtttatgctatcaattaacatgtggacactgaaatttaaaatatcccatttatatataccatttaaaaatataccatttaaaatatagcattatattgctcagaagaattaaatacttccaggtaaatctaagcaaaacatgtataggacttgtaagctgaaaattatgaaacgtcaatgaaaaaaataaaatttaaataaatggaaagaccgtgttcatagattgaaagacaacatagtaaaatgtcagttctctacagattgttatataggtttaacacaattcctgtcaaaatcccaggaagatttttttttttttagatatagacaaaagtgttctacagtttatatggaaagataagaaactggtatagctaaaacgattttgaaaaagaagactaaagtagaaggaatcaaactaccctatttcaggatttaatatacagctgtagtaatcaagactgcggtactgacagagaaatagacatagatcaattaaacagaataaatagaccttaaaaatatgcccatctaatttttaacaaaggtgtaaaagcaattcagtggaggaaagacagcctttttaacaaatggtactggaggaactggacattcacaggcaaaaaatgaatctcagcctaagtctcacactttttacaaaagttaaagtgaatcacagacttaaatgtgaaatgtaaaaacatacagcatttaggaaaaaatagaagaaaatcttcataaatctagggctaggtgaggttcttagacttaataccaaaagcatgactcataaaagaaaaaataataaattagacttcatcaaaatttaaaacttttttacccggcacaagaccctgttaagagaatgcaaatgcaagctatgaaatgggaaaaatatttgcaaatcacatatctgacaaagaactgctatctagaatatataaataattttcagaacacaccagtaaacaaaatacatcattagaaaataggaaaaatatgaatagacatttcaccaaagaagataaccagatggcaaataaacacatgaaaacatttaacatcattagccataagggaaatgcaaatttcaaacatgagatattatgatacttctatcagaatacctaaaataaagaataagaaaaatgccacatgctagtaaaaaggaggagaaactagatcactcaatacgttgttggtaggaatataaaatgttacagccactctggaaagcagcttgacagtttcttaaacaactaaacatgcaactaccacataacccagcagtttcacttctggtcactcatacagagaagtaaaaagttatattcacacagcaacctctacacaaatgttcatggtagctttattaataatatctctaaactggaaacaaacctggatgtcctttcaatggctgaatggttaaaccaactttagtacatctatgccgtggaatactactcagcaataaaagttaacaaactcttaaaaattaacaaacccagtgaatgagactgagtgaaaatgcccagttccaaaatactacatgttgtgtgactcatttatataacattctcaaaatgacaaaattatagaaatgcagtaccatttagtggttgccaagggttagggaaggggtgggggcaggagggaagaggatgtgactataaaaggtcaacatgagggatccttatggctgtggagaagttctgtatcttgattgggttaatgtcaatatcacagttgtgatattataccatagttttgcagttgttaccatttggggaaactaggtaaaaggtgtagaggatctcctattattaatattccttacaaatgcatgggaatctacagttatctcaaaataataggttaaattaaaaaaaaaaaaaacagtttaaacacaaaaaaatcaattgttttgatcaggaaccatgatctagaagaaaagccagatatcccaaatgagaaagttaagaaggactaagacaacatggagaagagagaagattagcattgacctggttgggaggaagatcaggaagatttcacagaatttatcacatttggattgagccttgaagaatatcaggtgtccaggagtagaagataggaaaaaatatgcagaccatgctaaggatgcacatttttcatcgtgcatggtcaaaagttgtggtactatgtctcaaggtatatacgaggcaatgaggagacagtttggagcctccatcaaggagaaccgtgagtaatgagggctgagtttcagatgccaagctctgagttagaaattaaattaactgatgattctatcagggaagcgcagttactccaatgcacttgacacacagcttcgggagcagagagagcaatggcctattcccaagccactcaggcaggccaaataagcctagtaattcagcagtcaggattccttgacaattaggtggcattcatgcttttgtgcgtggcgggttgcatgtcagagacaaaacaagaaacaatgaggtccggaattgaggaaatggaaaatggaatagaaaagaccagatggataatggagacatttcagaagacttggagactcccagattagggagaaaagtctgagctgattccagatttctagttcaagttactggagaagctggaggtacaatatcccaggaggtcccttcctgagatagacacatgtgaagataaaaagatgcaagggggagggagataatgcgttgggttgagacacattaggtgtgaggtaatgctggaagtgtccagaaaatagttggtaatttggttctacagttcaggaaaaagactcagactgaacacatggcatgagaagtttgatgaggccacttgagtgagaagaggttcaaggacagaacatgggagaatatcgactttcatattagggaaagtgttgaaagtggagagaacagagattaggagaacatctggaagacagaactctgaagtctaggatggagagtcccacagatgagattatccatagtagagtcccagagtcacaaagagatcctacagggtcagacatgggaaaagggcatggaatttgatgcgtagggcacagttgttgcaggggagtagtgtggcagaagtgaagagctatgtgaacagtaaggaatgggggcagggagagagcaggcagctgcgactggcctttcatttttcagtataattcgtaatattactattaaagtattttcctcccattaattttcttgcacctggaaaattattctctagcatcatttttatcaacctgtatgtttgtgaagaaactaaaacaagcagaaccatgaagaataattgagtggcaagaaagccttttataagaaagttggacatttgtaatgtctcaattcaaatcatcttatgtatgttttgtttaaatatagtttctgttattaaaaacaatattggtgggtaaatgaaagtttgcaatttagctttgggttacttttaactttcagaacgagattatgaactctgtgtgcatgcgtgcacatgggtgtgaatttcataaaaattatattttccaattgttgatgaagttctctttcccatttctgattttagttgaatgcctgttaatctaatagtaaaagacttttgtttcacaacctctgggaataccatgtagttgcagaatatgagattttagagacagaaactaacctggtggaaattcaaattcatcttttatcttttagataaaagcctttgaaatccttttagtgtgaagttatcagcaggcttgattctcatattacctcattactaacccaaggagttttcaaaatgcatagagaacaatgctctgtggctgaaactaggtttttatcactactccagtccagtgataagccaaatgtggcccacctagttctacttgggaaattctgcctgctcaccccgataaacctttggagatcatgagatcacaacacatatagaaggttctcataagttgtgcactgaagaaacctgttcgagtttatttgagcattttcaaaacttcttaaaccacagaacctttttccacattaacatttcataactcacctagggtttttgtaagataagaagtggaataaatgcttttgaaggattgatgcttcagcactgaggtctgtactgctggaagtgatggcagtgttctccatatatttttgtttcatggattggactgggtgaagtacaagaaaaaattcttactgcactgatctcccttctacccccagaatggcaaaaaatcagcttattaggtactaaggttttgcatgtgttcctgaaaaattatttttatcagttgttgcgtctactgtcattcaatggaatacgctctccattatgtataagatattttgttaaagatagaaaagtatgaacaaagaagtagtcatatcaagttcaccaattgttattttaaggcttacttaaaacaggataattcactacttgggggaaaaggctgatttccaaaactgcagctatgtagtgatttactcattccataagcctatgatcttatctgctcggatttacatttggagcagtaaaacctctggcagctgctcttagctgtctgcatgaagaggagacaggagataagaacattcctgattttattgctttctagaacatttgaagttggggtgggggtgggaaagatgaacctattgtgaccataaacgtccatcgagtctgataccaaagaagtaaaccagtcctcttagaagatgtggtaaatctcccaggccactggcctccatttgtcaaaacctgttaaggcttaaaaaagaggagagctgctgcctcttcttcaacagaaaagcaatcactccaatgttaagatagtttagggctttgggataattattgccaggtagaaaactttcaactattcttattgtgagctccccagatgaccttaccctactcccaaagagctccataggaccctgggcaaccttggagcaagcttcagcccaatccaactaacaattccagccgggatgcagtgtgggacagcatttaggggagggtgttgccacagactctgcccaggcacacctgccaatagcatcaccactgggaaagtggcagctcttagtacgacttaattggagaccatttgggattcctgtcaggtgagggtctctaggaagactgttaaaacccctgagttttgatgacttccaggatgtgttgaagggtctgtattagctcattctcaagacctaaaattttcttacgctttcttctttggacattagttcttcagttaaaagctgccaaaatcatgacagaatctggtgggggagaggggaggaatttgtattgcctaataaataatctcatagaaggtcataattccatattagccactaaatatctgaaatgtataaagcatgcaaagttggatccaagatgtggatgaaaaacagctcggtgacatttcttaagaattattcattttcttttttaatgtgaaagtagagcaagaacattctcctaaatcccagacttagagagctgaacattgcctggaggccataaagaattacattgacaaagccatttttctttagtttttaaattacacattaaaagttcccccaaagaattttggaagagatctcaagctttcagattcattagacatagagggacctctggaaactcccatcatggtcttcatctgttgtcctaggaagacactgaaatcatgctagggagaaacgaagctcctcaattttggaaaaatgttcattattgtttcagtcttcgtctgtaatgcaccctggacccagctatgctcattggcacaaagttttaaattgttctgctcttgtgaatagctgcttccccccaacacacacacacacacacacacacacacacacacacacacacacacacacacacaccagccactgctgtagtgttttatctccttgaggactactgttacctgcctaactcattttaaccctgagttctttgaacctctttgtcctttcatcttccttaaaattgctatgacttatacctcttaaatcatccccgcaaaaccactcatcccctaaaaataaaaatcagtccagtggcaaaatttgttgaaaggcaaggagaaaccattgtgtcttggtttatgggaataatgctgggcagagaaatcaatattctttgaaggttgtcctcctaccatggcaaagtggagctctccaaagaggtctttggggttggacataaactcaaagcagtgcacatcttatgtgctattagctcttttctggaatgataatgctgacactcctgttattttccttttaggcaggtttggtcaacatttcccatctcaaatatattttctctgttgacagagaccagatactgctacactcagcacacaatggaagtcacaggaaacagtatctcagtcaccaaacgctgtgtcccactggaagagtgcttatccactggctgcagagactccgagcatgaaggccacaaggtctgggcaacagagcaagtgaccagtactacatagccagctgccttctcttcagacatctgccagtactcatgagcagattcttactcccccgtgaaggctgtcttttgattgtctttatgctctatgaaaagacgcttcctttcctgtttactctaaaagaatacacatttataccagagcataggacaactgatataaattgtgtaaacacacatgaagagggtgttcagtgttattgtaataactttcttcactcagaggaaagtaataaagctaccagaaaaaagaggagcaagagaccagttatgtccatcacagtgaagctttgcagatgtacccagttcattcatcacaggaggaccgacgcaattcagctttgataactttctgtaaagtagggctcatgttgtgactgggatgttagtttggggagggtctccattggctcttgagtcatttgataggtgatggagacccatcttgtgtgttcgcttaagcttcacctggtacctgtagaagcctgtatacggaaacacatggtgcctatgtacagaagcactcagtgtaaaatgagcttgggaggcagccttgaaggggcatatggacaatcacagaaaggcagccttgccctctatacgtgtgtctatacatgtctatatgctgtctatacgtgtgaccttaacatagcatactttggcctttatttagcagctgaacacttctgcaggtggccttcctggtggtttgggcaatgtccattctcaatacctgggaacagcactgtttcttaagaaggcagacacctaattttcaagcaacctcttgaatacactaataattaaaattttaaatataatctgcctattctgctcctggttcaaaatgagtaaaaccaaaggctttccctgacctctccagcaaattggacttgattctgaggagttactgtggcctctttaccaaggagaaagttaaggattagagaaattgggtcatatgctcggtcacacagctggtaagtgacaggcacagaattccaactcacctctggtttggagtctacctccgcaacattatactgacttcctggcacgtgtcactgtgactaaagactcaaatccctgcaggaaaatgactgtatagaatgttattaataaccatcctatgactaggaatcacctgggaatcttgttaaaatgtagtcctaattctttgtctggggcaaggtttgagattctgcacttgtaacaaactcccagctgatgttggagctgctggtctgtactttgtgtagccatgccccaagaaagtttttgtcactaactctgtgggtttatttctttctaatgatccacgagtaaggtggtgtaaagcaggagtaactgcatgaatgaaaacccttcaaacattaactcacccaatgagaatggagacacttatgcaaacagttctgtgaaagtcagtactcaagtttaaaccacccgggttgttgccacttgactctcacttgaaaacttggcaaacgaaggcttaccctctcttcctcaagtagtcagaaagagcctcatggaaaaacacggacgagtttctttattcccattttaagggcgaaagaactgaggcccaggaaggctatacacctttgtaagaatcgtatgggtggagggtgtcaaaaacaaaacctagctctcttgaagtttggcctggggagttttcatgttgaccagattgcttctagaagaaatattatccccagccttcctgaacgtagagttggcatctcctttatagattaggtaatttttacttgcatcttgccatgtgggcgacagtgccttcaaaaaccctgcctccttccaagacatgctggcttctcattatctttttttcttcctttctttcaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagatgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtagagggatcaggtccacagtggtgcagattcaaccaccacccagggagtgcttgcagactctgcatagatgttgctgcatgtgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcaatattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgtatcttaccaggctcctccctgcaaatgcacatgtcaatcaatgattaatgcacccaggttatgtacaaggcactgggcttagcaccacagggaacttccttccagaggcttgctttctagttgtgtagacaagaatacatgcatgagaagatacaagacaattcacccatgccaaatgattcatacaggctgtttaagtactgcagaaaataaaagaaggaaaggctaccagacttttcaataaggtctacagcttcccaagagcatgtctttgttaaatcaggaaatataaaaattatgtgtgtatgtgtatgtatatatatataccaccctattaactattttaaaatcgtattctattttgggggttgtgttaatgatgatgaaccagaaaagattttctcttgatggtttcttcaacaggaaacagatattggaatagtgtacatgtcatttttatctatacaatgaatttattatatttttcttagtaaagtgatagacattgaaagcaagcttgaa

SEQ ID NO: 1167 - DNA, 143631 bp, Homo sapiens
ggccagtgcccggcgcgagtgggagtggcgcgcgcgcccctagccgccccccgcctctccccgctgcgctccctcgctccttccctgagctcccgggctccggcagcgggctggcggggcgccgcattgcacactctgggggcgccgcagtgttcgtgggatggggcagcgggctgcagctggcggccggaatccgcgcgcagcccgggtgagtagaggcgggcttcccgggagagcacaaaagaacaggggattggtgccagcggccccggcttaggcggggcctggccaaggcagggagtgcgctgagtccctggaactacccgatgctagggcagtcccctggggccagaggaactggggtcccggcctccggcgttttgcccctagtgggcagagagccccgcgagtagcctggacgggtccagaggggcgtgtgtactcgtgtgtgttgggctggcgcgtggagggtgggatggaaaggtcaggagctgccaagttcaaggctggaggaacctttcccaggagtaattcagcatcttctcacggcccaacatgcgtccaccaggaactccagccggagggagttcctgggcggcggactggcagcaccccacatgttgctgcggggcggggggcagtggcggtagcccggctgcggccacccggagcctctaagggaggtgcagtgtgctggaggtacctccccgccgctgcaagaccacgctaggcctttcagccatccaccccgacaacccagggaagggaccatccacccacagagttgggatttggcctgggcttgacttggcgacctgtttttctctccggtaacagcagttccgttgattcacatttggctaagcgttcagttacaacctaaagctcactatctgacggtctgactcgctctgacccccaccatatcctcactatctctaccgctgccctcctccagtcccctctcccgccccagtatctgccctgctcctcactgcggggctcaaaacttggtgtttgagcatgattgccttcggtgtggtccttggcattttcaagtgtcacaatcacatcccgtttcctagaggactccaaagacttgttataatgggatcgggggagagaattgggtgggggggaatggaagagggtctttggtagtcacttgttggaagaacagcattgacctcccagagcatatgacaaaaagaatgttaagcttctttctatggtaacctacccaaggtgtgacctccaaaattcaattttctttgtgggaggcaagggagtttagattctccagggggaagcttatttcttgttaaattgacttgcggtgacatacacactgttctgctctgctctggccagccattgcagatgccatgatattattagagcaattcccttaaagccattacattttctttcgagtgagaggaactcgagctagctgtttaaaattttggatctgcaccttatttctctagaagacattaatggttactgtatatgcgctcacgtgtaccaagtttgcaaaaggtatttgtgcaatcgcccatgaaatgggttaatgcacatttatgttaaacccatttaaatgtaaaacatctatctgttttcaattttagtttccacctcgaccaaaggcaccagactgaaataagacttaaaagaggcttccttgtttaaatagaggtttatagaactctagtcctgagagcacacagtaagctttctgagcttgtaggcacacaaagcttgttaaaaattgtgaaatggttccttgagttagaaataatggaaatgcttccagaccaattaagacagacaattgatgaagctacactctcaagctgttgacagtctttgtaaggtgaatgtttatagtacataatgcataaatcgggctgattctaggcaaataatatcaagtaaaaaaccataccatgtgttgtatcatactggatagtttatatggcatattgaaatctactattaaagtgtctgaggaaatcatatctttatcatccccatttcacagatgaaacaactgaggctttcaaagattgacttttccaagatcaatagcagagttcagtcaagtgtttttcaaattctttcctacctcacccgttcccttccttccttcctttttggtgtttacctacttctttgttgtttacctacttctgatttctgcacctctttttactgtttaacccatagcttgagggaccattgtgaatcatccccaaaaggctttgctgtctgctcaatatcatttagctcccactaaggtgagggctgataaagaattaaggtgaaaactaggaatagttttaaagagctacccttttcaaagagatacgttatttttgctaatgagttgttaaaggtacatataatcaaacccctaaaggatgatgtcctaattgtaatgtttcagaaagacaagtaacagtaggagagatgtgtgagaaatatgtaagtctcctattttataaacacactccttataagctctgtagacgattaacaatagaaataataaatgaatatctcattagtgctattcttattttaaaaagaattgacaaaatagatgacttaaataaaatcagaactactctggaaacacaaaaagcacccacttatcaaaagtcctgaaatcctcattgactagtgtacaaatgtagcagaagacattggttagagagaaatcatatttttacttgcaaagctagcaataagaagcgtacagatatctgcctatctgattattttttaagggctcatcatctgcaaatcttttcttggaaaatgattgcttacaatatttacttgtgtcattgcatactatttattaatgagattaatctcatttgcaataacgtggttaagtgttgagcttactactagtaagtcttggttaagtatgtgggctttggattcaagtcttgtcttcacatacactaactgtgggacttcaaaaaatgatagaacttctctgtgctttagttttcttatgtgtaaagcatgaataatgcacctacctcatgcagtttttaaaatttattcatgcagcaaatattcagcaattgcctattaggtaccagctctgctctagatgctagggatacatgtgcaaactccttgctaatgaagtttaccgtctggtgcctgaaatctaatgacacaatgcatttaaaatgcttgggatgggaccttacacctaccaaatgccccgttattgttagctgttggtatcatacattctttcaggaactgttcagagtgcctaccagatgtaacacagattgcagcatgtaatgatgaatgatatgtgtttcaattcaattaagtcttctaatggaagaggggactccaaagaaggacatcaagagtataatcagtctctaaaagggaattcaatgctgatatgttagggaagaaatgaaaagaaatacttaatttacccataagaaagtgggaagcatacgaattaccttatagaaacccaaaagtgataagaaaaacaagtcttgtacccaagctctgtaaaacactaaactcatagtgaaaacacatagggaaagtaaagaaaagaaaaagaaagcttacctggatacatgtaatgaaaaaggaaaatttgaagggtcagtttattaaattgaccttatgaagggcaacagatcccaggcatactagaaatgggataaccaaaagtgaatttgttaaaaaaaaatccttgcaatggatttccaaaacgataatgaaagtcccttaaatactgtgaaataaggattgtggaactactcatctttcatcataccaaacatgtactgggagataaaaagagataaaacagcgtgtaaatgaattctttgcttctgtttttgctgagtaatattcctacacccaggctttctcaagcaatacacacattggaggtaatagatcaagaagtggcaagtgctgaggatattccagacctaatcagcagactaattacagataaatcaccaagactagatggccttcacctaagtatattgaagaagcctggtgtgtacgtgacagcaatctggggtattgctgggggattgactggtgtccttgggggctccagtcaggggaggggtttccagaaggactgggggccaagaaaccagacccgtgtccctgtggatgattgggagatggatattcaaagtaaacacagattacagcaagtaacgattttttttttttttttctgaagaagggggattgacgtattagagttaaaaaaggaaaatacagtcatgcacctcataacaatgtttgggtcaagaatgcactgcttatatgatggtggtcccatacgagtatagtggagctgaaaaattcctatcacctagtgacatcttagctgtggtgatgtcgtggcacaacacattacttacctgtggtaatgcttgtgtaaacacacttactgtgttaccagtcttagaagagtatagcacgtacaattatgtacagtacatactacttgagaatgatattaaacacctatgttactgatttatgtatttactgttaatgcaatttatcattatcttagagagaactcctacttatttttttttttaaagtgaactgtaaacagcctcaggcaggtccttcaggaggtattccagaagaaagcattgttatcataggagatgtcagctccatgcgtgttattgcccctgaagaccttccagtgggacaagatgtggtggtggaagacagtgatattgatgatcgtaatcccgtataggcccagcctaatgtgtgtgcttatgtcttagtttttaacaaaaaattttaaaacatgttttcatttaatagaaaaaaagcttacagaataaggatttgaagaaaataagtttgtaccatgtgtttgtgttttaagctaagtgttattacaaaggaatcaaaaagttaaaacatataaaagtttgtaaaataaaaaaattacagtaaactaaggttaatttatcattgaagaaagaaaaaatgttaaagtaaatttagggtagcctaaatgtagtatttataaaacctacagtagtctacagtaacgtcctcagccttcacttctacttcccactcactcacttgccactcactcactcacccagagcaacttacagtcctgcaagctccattcatggtacgtgccctatataggtgtatcttttttcttttataccgtatttttatggtaccttttctatgtttagatacacacatacttactattgtgttacagttgcctgtagtatttagtgcagtaacatactgcagaggtttgtagcctaggaacaaaaggctataccatataacttaggtgtgtagtaggctatacatctaggcttgtgtaaatatactctgtgatgttcacacagtgacaaaatcacctaagatggctctctcagaacatatctccattgttcagtgatacatgactatatgtttgttgccaagtgttgcaggaaatatattttaatgtttcagaaagcctaaccaggtttccgattccagttccctcctcattcatgaccttttcttatgaatgggaaattggctaaggaaacaaaaaacaaaaaatggagatcaataggtatatctctgagtggacaaatagcctcttccaggaagtagtttggggatggtctaatttaacacttttgtaaatgcttatgggtgatatgcagttcttacggtaagtaaaaaccaagctgctaaagttgaactatagaaataacttaaaagatcatctaaataggaagaaaaataatagaagattaaagtcaaaatggaagattgaagataagtgtacttggaaaaagcaatcccaagaacatttataggagatagttttaaattctgttcccatcagcagatagcatagctggctagtagtctctcagctctctaaaacacatgtgtccaccaagttaaagtcagtgttagaaaaagtgtaggttataaaactctgtattaatgtgatgctattttaaaaatatatatggctgaataagtttatataaataaaccctctctatttgttcatctgtgtggaaagaaatacatcaaaatattaacagtgactctctctaagtaatatgggattggaagtgatttttattatcttcttttacctgtgttctccaaattttctagattaaacacatattcttataagacaaaacattatgaaaataagatttagtattataacctcaggtttcatgtagtgttaatagaaagaaagctcatttgattattatttctatgtcttctgaaaatctgtagttgaaaatttttttgcctttttctcccctctgaattccccatgtaaaaagggcagcatgttgaaataacgtgtgtgtgtgtgtgtgtgtgtgtgtgtgtgtttggtgttaggaaaaaatgtggttgatgtgctttttaaaatagaactaggaaatgtaaaaagatttcgtttttacattcaatggattttacattcaaatccataactcaggatttgaagaacaaagttatagaagcattgctgatttctttctagactgtaagcgctatgaggacaggcaccgaatctgtttctttcctttctgactgtgtagtgcttgccttggtgtctagcacagaagactctcccagtaaatacgttggaatgttttgaattgaatgataggattaaaaactctgataagcatgtagaaatttgaaataagagtttctagggcccattgtatcctctgaggtcatatgattcactcacgttttagtttgtttctctgtaagttatcctggcagtctttgtattatatgacccctgggccacaaaagtggtttgtgctggtcatctgggatcctctggcttattctcaagttttgatccagctcctgccacttgcatccatctctcatttcagttggttttgtgctttggggctggtgttttgtttctttccttggctctggattttgtctctctttcagcctttggcttgggttcatcatctttttctcccactgtggacaccagtgtatataatcccagttagctctggccccctttaaaaaaaaaacttatattttaggttcaggggtacatacacaggtttgttagataggtaaattgcatgtcacagggatttggtgtacagattatttcctcacccaggaaataagcatagttctcaataggtaatttttcattcctcactctcttcccaccctttaccctcaagtagaccccagtgtttgttgttctcttctttgtgtccacgtgttctcaatgtttagctctcacttataagagcatgtggtattaggttttctgttcttggattagttcacttaggataatggcctccagcttcatccatgttgctgcaaagtacgtgatctcatttttatggctgcatagtattccgtggtgtatatgtaccacattttttttaatccagtttactgttgatgagcatttaggttgattccatgtatttgcatttaggttgattccatgtatttgctattatggatagtgttgcaacgaacatacacattcatgtgtttttatgtagaacaatttgtattcctttgggtatatacccaataatgggattgctgggtcaagtggtaattctgttttaagttctttgagaaattgccaaactgctttccacagtggctgatctaatttacaattccaccagcagtgtataagagttcccttttctctgcaaccatgtcagcatcttttattttttggctgacccttcttgataagctagaatcttttaaagagtggtttataccacaaactattaaatattaacaattgaatattactgtggtctgaatagtggcatacctccaaaattatgtgttggaacataatccccaatgtaatagtatcaaaaggtggggccttttggacagagccctcatgagtgggattagtgcctttataaaagaggttgaaaggagctcccttgtttcttctgccatgtgaggacacagcaacaaggtgccatccatgaggcagagaatgagccctcaccagacaccagatctgctggtattgtcatcttggacttctcagccttcaggactgtgagcaataaaattctgttatttataaattaccccggctaaggcattttattatagcagcctgatggactaagacaaatattaacacctgatccccagaagggatctaggagtcattgtagattgttctccaatattagcttaataaggcactgtagtcagattattcagtaatatccctggtattgtcagcaggagtcttggcagaagaacagaaaattttatgttgtttttacataaaatctggtatatatgttacaacatgcaacccttattgtcattttcaagaaagacagatagggaggaattggataagagcaataacatggtcaagccagtgcccaggactttgagtgaggacttaggggaagtagctattttctgacgacagaatgtaaatagaactctggcttggaagataaagactcaagggataggagcctagtgtatacattatgaaggtcactgcctgctagagagtcttctttaactaatccgactccaagactaacacagaccaacccaaagactacgtataaccagaaggccatagggcaggaactcctgcttgccatcaggtgcttctctttgagggagttcttgaaatggtccacggctcaggtgtgaagagatgagatctatattggacaggttctggagccatcgtggcttagaagcctcattcccctaggagttgatatctcttgtaactccatagacaaagcttccaaggtctcatagggatgtgcccagtttccagaatcatggccctcagggaagccccaagcatggtgtcctatcaggtaattttagttttcaaccagcctaccaattacagtcatagctgtaacttgttactatgacgtttttactcttatcaggttgctacaataaaacagctagacagatacccaaagtcaaattctcatgcacagttacaagtagagtgaatttgcattatttttcacaaaaattaaaaactagaactagaatacatctgttgatatctgaaaacaagggattttagacagaaagcaatgaggtcagactatgtaatacccctacctcctgtcctgcattcccccctgctcatccttattctctggacaagaggatgcaaagtaaaattaaaaataggttcaaaagtgtttaggtgtatgcgtgagtaattaccacataatggattgttaggcaaaacgaaagtattgggtgtaaaatcttcatcttttgctagaatttttattgaattcttttaattcagattcctgatcacctaaccgaatgaattcacaacaacttttgcagcagttatgacttgttctcagccatagataaaggaattcgtaaacccaggattgtcctactatttctgccttttcttttggaaatcattattgctacttgaactaccaaaaaaagtatatttaagcattccaggtgattaaataacaatgcagttagtgtgtttttgtagtaggattttgggtaaacattttcaaaaaatatttaatatttttatgacctaaaaaagcaggagagataaaggttattttaagcacaatttttagtgccttgtagtataacatattagcccagatgtacatgttacttaaatttctatcaagatatctagaaatactagttcttttatgctgttacagaactttagataatataatcatttacttgcacttataataacagcatttattaccctctacttttacttacatggtttttcatccacaggactctacctgcttgtgagagattatgttaattttccattggcagagaggcaatgtagagggaaggttggaggtctgggctctcctgtagtgtaattctgcctccaccagttgctacctgtgtgaccttgggcaagttatttagtttcctccaattttaccggctacaccattaactagctggctgacctttagccagtaggtcacccactgggcatcatttgcttcagctgtacaaatcaaaaggctttactaaattcccagatgtgtaggaaccaacatatagtttttgacatttaaaattacccattaatgctgatctaataaaattgctttgattaactgaaagtgtggcataatattggtatatagactaaaataaataaacattcaagaattcttgtcttctaagaacatgagacctctaataaataatttaaaaggtgtagcacatccccccagaatatattttcttgctatgtagatcttcactgttctttgactcgccatgtggaatacatttaatttcttagaaaattttcaatcttggagaaaaaaattcactttcaagtgttctaaaaatattgccatttaaaaatactgactttaatagaagtaatatcctgcgtttatatagtggcttttcatggaagatcaaaggaatggtattagaagtacatggtttttcttttatgtataacttcataggagaattttcttttgttgagttcttttaattcagattcccgatctgaattaaaagaactacccgagtgaattcacaaaaagtttgcagcagttgtgcctttttctcagtcaggtgtgtccttggtcaggggtgtccttccatccattattccacaatttacaatgcttctcatccttcaaagcctagttcaatgcagcctccccaaagatgccttttctcctgattccctcatcagtgtaaattttgctcttttacgtatacctgtattttgtagtaacatattctttgttacattctctacattctcttgttacctgtatttttagtcttatttctcatggatgccaacatgaacataatgttttgcatagagtaagccctcagtcaatatgcttaatagaataatgcctttcatagagaaaagctgtaaagatctggggggaatcacaaaggattgcatcttagactcgttgtgctactataacaaaatacctgagactgggaaatttatatcaaacaaaaatttatttctcacacatctgaggctgagaagtccaagatcaaggcaccagctggtgagggcacagtctctctgcttctaagatggcactttgttgctgtgtcctcacacagggaaagacagaagagcaagtgagttaaggccatgtgaagaagtctcttctataaggccctaatcccatttgcgagggaggagccttcatgcataatcacctcttgaaagttccatctcttaatactgtcacatgaccacacctgaattttggagggatcacagggaaaccatagcagattggtttagatggaagggataggttttgcattatatgacaaactgttacctaattttggtccctggatgtccaggaagaacaaatgaataccacaagctatacacattcttcttagagactctactctgctgctgtgtccttataatgaataccttttaggtattgagggtattcacaaaacagactctaagccctgagttgcccatgacctaggactttggaaagttaggtatgatatttttacccttaccctggggaaggcacaaaactattaatgaaggatatgcccccatgacccaaatgctaggccccaccttcaacacttgggatcacatttcaacatgagatttggatgggatacaacacccaaaccatatcagtgggtaatttctatttttaaaatatacaaaagtttaaggaagaaaataatcattccccattttatcacacagatttaattattcgtgtgtaatttctttattattttaatgatattctttttctctgtgtcacatggtggctacctagttatggatacagcatatgttgaatgtatttgatccttatcttcctagagtaaaccagaggccaatatagcaaatttactatgtataaagatgtacactgttcttctatgctactgaaaaactctttcatcagtagtctcccatgtggcctcctatttgtgggagggaataatgtgcatagttagggctggtattttttaaacaaagaaatagacaaggccagatctgtttaatctctaacggccagtgttctttctgttcattcccatagattagaatcacagccaactggcttaaaatgttgttttaaggagcaccaggtgagaggtggccagatcagcatcagctccccacagtcctgataaatgactcaggtttgaactcctcctgttgccaatgttgttattctttggtaaggtgaaccaggcaagcaaaaatcaacatggtacaaaaaaatttttctcaccaaagctatttggaggctcaactttctcaatgaagggcactgcatttcatagatagaatagcattttaaagacatgtactgtctataatggtactttcttctcagttgggaactatttaggagagatctgtgctagaggagacagttttcagctaggacatgcaaattcaagaaaggtccagtgccatagcgtctacaagacgtcttgtagagaagcaagcagactcatttcctatagcttctgggcagttctggcattgcatgtgtgtttcagatctcttccggagaagcagtgtactgaataagatcgaacatggaaaatggaaaggaagagtgggcagagaagaaggagctaaagaacttttaataaagaaagtatcatctactttataatagattaaaaaaaaacttttcgatcctatctgattcctgtcctatcagagaaatccctaaaatgaacaaatttgaggagaatgacaaacatccatctgccttaaattatcttccaaatttctgccactcccagcttcaaagccactcctttggcaagtcattgattcagccttagaagatcactgttaaaagccttccctgaagggaaaatcatgctcgttaatgaatgaatctaagctgggtaacatactcttccagtaggcaagtgaaagctgggggaatatgagtccaagcaaggggactgagatggggaaatagaggaggtaactttttccttgtaagatgtgggtggaaaggaaagatgttgagatctttgcttgtttcccactttcatctaaactctcatcatgctgtttgctgaattatcaaccaccaattagtggtaggttttaggccaagccaggtaacttctttgaacttcagtttcctcaaaatgattgcttaagatcagcacttccaaaggaggacctgtaaggaaaaacactggttctgtgggatattacaggaaaaaaaaaacagtggattaaaaatgtttttgttttttgagttgcaggacttttagaacatttagtaactgaatgttcactctatatatctgaaagaaggtgtgatatataatattcagtgattcccagacctatttgacagtgatactcattttgagggttcatcttgagggtcagtgttttctgaacacaaaatattggactatctggtgtctgacgtccttctatgttttaaattctgtgaatgtacaattagtttgtctctcctcctatttctttcctagccagcccccttgcctcttacctagaactgtttttgtgttgtgtgtaaaccatttgatcaacaatgtactctgttagaaaatctctgcatctactttaagagaagtgcatgttgagatagtgcaaatctgcaagctatgcacttttcccttttatttttatattttagactacattaagtcaaaggcagtcaaaaagcaaacaataaattccccaagtgctgtacaccctgcccaatatcctaataaaaatattgaaacatttatactaatagaggggataatatttcagaaaagaataatttacaaaagacccaggttttattccgacagaggcgtttctaagcaaagcagggcaattaatcatagagctgtaacataaagatgaaaagatgaatactgaatatatagaaaatgtgcgctattcttcccttcatctttagaattacaaaagatgtttatcaccccttgccttaccaacaccaatcttggattttttatttggcttctgcaccagattcacccttgacttgatgaggagcaggtaaaagctgaagtgctttgtgggagtgggtgcgggagtggaggaaggtatagacatccaggatgtaggatggctgtgtctgaattagacctcctcctacaaaaatagctcctcttccagatgttttttaaagtgagggaatacaaggtggtcatctgtaatctcttgagtcagaaagagaaagaggcaggcatagtgtcttgtgcctatagtccacctacttggcaggctgaggcaggagtatggattgagtccaggagtttggggctgcagtgtgctgtgactgcacctgtaaatagtcattgcattctagcctgagcaacacagtgagactccatctttaaaaaaaataaaaagagagtaaggattctcactgagacaccccccgaccccatctctgaaaaaagaatgaataaagagtaaggattcacactgactatttttcatatacttattgttgcatgtcgtgaattctctgaaagtaaaatgatctgaatatctacaggtaacctacaggtaatctatagcagacatcttactgtaggctatgtgtttggtttgattgtctatggtccacccttaatttaaattttttttttttttttttgagacggagcctcgctttgttgcccaggctggagtgcagtggcgcgatctcaggtcactgcaagctctgcctcctgggttcatgccattccctggcctcagcctcccgagtagctgggactacaggcacctgccaccacacctggctatttttttttttttttgtattttttagtagagacagggtttcaccatgttagccaggacagttttgatctcctgacattgtgatccacccacctcggcctcccaaagtgctgggattacaggtgggagccaacgcacccggccttaatttaaatttttaagaatatttgtcaaattttctggtatttgaattcaagcttacctctgatgaaacattaatatttctatttagttttccttgtcttgtttaaaaaattggaatttgttgtgtgcatttgattatgtatattttaaaactccaaattgcattttgaaatttggcagacaactgataactgtatttttctcaaatatataaaagatatattaacaatattagctttgctctgaggtctcgtaggtctgtagcctccttgagttgccttagtgaggcttccaaactgcaccgtgctccagtttttgaattaaactcttccatttttagaggccacctttactattctcctgaacatataaatgatgccttagtttactagtctcaagccctggcagagaatagatgtcaagtagatatttgatgagcagactctccctacttgatcagtgtttcttgaataaatgaataaattgttaatgataagtgcttattataattgtcaccacttttattccagtaatgtagccactgcctggcatctaatactattttttaaaaacagttaaaaaatatttttttttgtaactcacaaacttgatgttaattcgtatttaatgtttgtttttctatttaaaaaaatgcataaagttaaaattattgtacataaaagtttttacacagatttcacaaagctgaacacatgtgtctgtgcaattggttctgtactgcagcagctcaatgaacttgggagagacctgagtcctctcacgtaggactgagttgctctttatgggactgaacataagtgccataaaaccacttggtagggtttgttttggcatgttacagcatttcccctcgggaatgctcaaacattttatggatggaggatttccataaagtcttctacataaccttcaagtcatcttgtgtgaaaaagaacttagtttgcatttgttctgtagataattgttgatgttttataggtaacactctagatgtgtagaaagattgaggctttccaggcacttctcagacttactgactagtaagtctctgttattaaaaactagttttgttttttgttttttgagacggagtcttgctctgtcacccaggctggagtgcagtggcgtgatctcggctcactgcaacctccgcctcccgggttctagcggttctcctgcctcagcctcccaagtagctgggactacaggcaagtgccaccacgcccagctaatttttgtatttttagtagagacggggtttcaccatgttggccaggatggtcttgatctcttcaccttatgatccgcccgccttggcctcccaaagttctggaattacaggcgtgagccactgcgccctgcctaaaaactagttgtttttctcacaattctggaagcttggcagtcagaggtcaaggtgctggcaggtctggtgtctggtgacttgcagatggtggccttcttactgtattcttacatggggtggggttggaggggaaggtgagagaagagagggcgagagagagaagaagaagagaaagaggaggaggaggtggaggaagaagagagaagagagagaagcaagttcttctatgtctcattaagagcactaatgctattcaagagagccccaccatcatgatctcccaaaggtcccatctccaaatactgtcgcatcacattggggtttagggtttcagtgtatgaattttgggggacacaaacattcattttatggtacgtatcattcttttttaggttgggcagggaacaggctcctcatctctctctggcgttccccctattttccccaattccctaacaatttgaccaaagccatggccaacatcatcacttgacaaaatggaattgatttgttaaagcgcttgtttattttaagaatcaacctaaaggaaaaagaattcaagttacttattttggggtctggattgaaattttatttgctgtaattttatccccaaaatgacagattcctttttcatattttttgagtgggtatttgtgtcatttttttggcagcacttaagaaactatctcttattggtgattttgagaattgttcatacttgaacagagattatgagcttaagtttaaatagctttgaaatctttaaaaaatagttacatcttttaattgcatgaacactgtctatatttaacatgtccaactatttaaatgacctaatattttatatttgccaatgcaagcatagcaactgtcaggcaacaagtactttttttctgggccctacccagggatattaaaaaatagagtggagctgggcgtggtggctcaagcctgtaatcccagcattttgggaggccgaggcaggtggatcacctgaggtcaggagttcaagaccagtctggccaacattgcgaaaccctgactctactaaaaatacaaaaaaaaaaaaaaaaaaaaaaaagagtggaagacacagcaactgttctcatggaacttggcttctctccctgtctctctctttaaatacccaagggccaacttgtgccaatcatagttctgggtggaaatacaataataaatgaaatggataaaagtctctagggataaagcagtgaacaaaaaccacaaaaaattcctgtcctggtagagcttacattctacaggaatagaggcagaaaataaggaaataaataagaaatgtgcagtatgttaggcggtggtaagtgctatggagaaactaaagcgaggaaggggagaggaagtacaggggtgggtgggaggcagctggtacctttaactgtggttgtcatggatgactccactgtgaaggtatcacatgagcacctggaccagctaagggagagagccctgaggacctctgtgggaagagccctccaggcagaaatgcaaaagtgctgtgatggcctcatgcctggcttgccctccaagaaggcaggtagagcaagccagggggagtgtagtaaaaagtcaaagatgtacagggcaggctgtccaacatgcaaagccttagaggttatcacactatgttgattcttcccccactctcttccttccttctttgtgagttggggagccattagaaaattctgcactgaggaatgacctgattaaatgattttaaagatcactggttactgtgagaataaatataggaaggcaaggttggaaagagggagactaaataagaggctgttgtagcagtccaggtgttggcttagatctgggtggttgcagtggagatgctgaaaaagggcattctttgtctatttggaaagagtggaggagaggatctcagaaggataggatgtggagtataagtgagaaagcagtgtcaagcatgcttctaaggtttgggacctgataactggaagggtggggctgtcatttactgagatacaaagactgaagagtaacagatttggaagaggatcatgtcaggtgtgcacaccttagatttgagacacctattaggcttctaaatggagaaatggagtaggaggttgggaatatgaatattaattcaggggagacatctgggctgaagatgtaatgatgggagcttcatgatctcagtaaaagccataaaaggggagcaaatcctcgagagtgaggagatgagatcagtctgtcagagacagagtgaagacaatgaagttgcagttgtgtgctccattattatttgctgtaggtacagagagaagtaggaatttgtgggctagaaaactgaagcaactttcatgaaaagtgtgggacttggactggtccttgcaagtggttaggatttggagggttagagaaaatgaggagagggcattttggttaaaagttaccagaattaaacacagtgcaatatgaggtagtaagggaaaacacaccaaagtcatgatgggattttctcatgtgtggaagcggtaatacttgaagattttgttcagtctgtttccaaggatcatgatatgcaaatgataaagagacttgggtcccattaaattttttaacatttcccaatactttgctaacagcttttcctccttacccttgcagctggtgctgccttatattttgtagtaacttgaaactgacatgtggggaattttaagtacatatgttatcaaaacatgtttcacagactttatagactatcaggaggtcatcttgtctttcaaaaagcagcctggaatttgaatttagttcctcttataatttcatgctccaaagtaactatatgagaaatttaaaatttattagcaactttctcttgttcttagattttagagagatggcaatttcattaaacctgaaaaaaaaatatatatgctatgttacctagaggcagattattgaataactttacttgcctggtgataaatctaaggtgcatgagtattttaacgctttcccagcaactttggggttacatttttaaaaaggaaaaaaatcaacaaccctgcattcctttttgatacaaagtaacaaagcaaaaatgaacctcataaaagaatacaaaggatgccagcttcagaacaaatggttagagacattgtgccttttgtcccctctccccactttttcctagaatctatgtaagaatcaggtattgtttttattctgtcaaaggttttcatggagttgcaaaagctaaggactttggcagaactctctgaagtaagagcaaattatacatttcgttgttcattttccttaaagaatgcctttaaaataatgtggtgttaattgtttggcataaccaggtgtgacattccatatgcccatttgttctttgggtttcaaggaggttcagagtacaactcctgcaggacttgacagtttatctgtgtcccttgaatcctgcaggtgttggctggagagtagtaagcagttagtggcaaaggggtttataaagaaaccctgtggactctctagtgctgtccagtagaattttctatcctattcttggtgacaggaatattctatgtatgtactttccaatacgtgggtagatgctacccatactggctactgagtacttgaagtgtggttagtacagttgaggaacgaattttaagttgatttcattttaattaaatgcaagtagccacatgtagttagtgtctcctgtgcacttgtttttattctgtaaataaaatagtgactgcccagccaaagctaacaattcatcttgggctttctggagcacagagtggacagatgcccacactacccttgccggggcctttctgccatcctggtgagtgtccacaggcagatctttcacacagggacatggcacccctgcttatttccaggaactggacggtatacaggactttttgaaatgcctccctcttgtccttcccagaagtggggagaaggaataaggaaaagcagaatgacattagatgaggtgaggtcatttttatggtcttaaagacctttttctcacagagatattttaaaaaatagcctaggctgggtatggtggctcacgcctgtaatcccagcactttgggagaccgtacaggtggatcacttgaagccagaagttcgagaccaacttggccaacatggtgaaaccctgcgtctaataaaaatacaaaaattaaatgggtgtggtggtgcacacctgcaatcccagctactcgggaggctgaggcatgagaatcccttgaacctgggaggtggaggttgcattgagctgagatcatgccactgcactccagcctgggtgacagagtgagactccatctaaaaaaaaaaaaaaaaaaaaaaagaaagaaaacaagcctatttgagtattttattactgactgagaattatcctgggccgtagatgttagaggcagcattagtacatactgatcttgctggtgtcttgaaagtgagaattctgtgaagaaccaaatttcatacctggaggaagattgcgtgttcataaggaatattctctagattattattttaaaaatttaaaagtggattattgaaggtctaccatgcaccttcacgtaaatacaaaatgtgtatgtattgttccaggaagggggttattaaagaaaggcatagatagcacaggacataaaaatgatgaagattgggtcactgtaagccaaggaagggctgagtgtgtgacaaagacaggcgctgggccccaccccaggattctccagaaggatgttgctgttatggaagtcctggttaaaatcacactccgggagcatggtaggtggtgcaggataaaggaggtcttttgtctctcggtggtcagtttttacactgaagaagttggccacagtcttactgctgctgtggtgagctgcccctgccctgcgccagtatcagaagctgtcccagttgaatttgctgagaaaggtgtttaaaaagatttgttggttgatatttctgtggacattctgccactctcacttgtaaaactaaatggagcttatgtgccagggaccatgcttcacttgccatctaaatgaggaggaaaaaaatgtgtacatggaagaagaaaactaacgataaaaaatgctataaggtagatccccaatgagtggtgcagacagtaactgccatatccgatagttgtcttcaaatgcataaagggctggcaggtggaagaggtgttagacttactctctggggctccggaaggcaaaactggtggtatttctttttaattaaaaaaatgatttttgaaggcctatttatgtagagtactctggggagagagaatgatttaggagaggacagcatgttcaggatatggagatgtgacagtggctgcaagttacagggaagttcattccagtgaatagaagggagagcttcagaaaacacaacaggctgctgtgaggaggttatcccccttcatcggaggtgttcacaaagagaccttgcctactggctgggaaaggggattcatactggtagagcaggggtcagtcaaatctgggtggctacctccttttgtaaatgaagttttgttagaactcagccattgcccatttgtgtacgtatcctgcatggttggttttgcactacaatggtaaaagtgtgtaattgggacagagatcacttgtccctcaaagcctaaaatatttgttatctggccctttatagaaaaagtttgctgggccctacataggattggatttagagatatgtaaaatcctttttaattttctggttgtaagggattcagaaaagaagacaaaagccttgtgggaagtctgaagaaggtttcttgcaagatgtgaactttcggttgggccttaaaagaaaacgcttgctggtcctggcagaggaggcctgtccacatggaacacttgagcagatctcaagaggactgcatctctggtccttgaatgcagtgtacagactcattccagcatccatgcattcattcatgcattgtgactccagcatattgcaggccaatgtagtcatctacaaacacttcttggcctgctcttggtaaagtaagcacaaattctggcatgagctgttggcattttgttactaactttgccagagtgaaaatgctcgtgaagttcaatgtttatcattgagttttacagagttattttattttaagtataattgtctcacctagagacaacttagaatttatttatatattctgcttaattgtaggatgtaagaaatgatggttccaaaacgaaaacctcactgtatttgtaggagatgcaactcggagtgttaaggataggatgatgcacattactattcatgcctttttaattgattagcctttaaggcttctgcaagcctttaaaagttgttttgtcaacattagaccagctgctgtgtaattatggtagctcttcttgcagttaaattcctttaataacgtgttcaatctgccgatgccaaagtgctttgaacctgtgatatatactatggagagcttttgtttttacttacagatggtcggtgtcattttctgggcaactctagaattttcacagaaattttaaagatgaattacttgaaaatggaaggcaaatgaatttgaacatcaggttactcctccccctataaaatttgttcatatgtgacttgaattttgaacttggctcataacaacataaatgtgctcattaaaaaaaaaaattccaccttgaaacctttttaaggctcttttctctgactctccagcttgtaaattaaatcaaatctttctggcaccagagagatgatggtggaaacagtgggcctgtaacaaagatcacttgttaatgaggagccacaaaagggtggttctgccttccattcaggggctgaaacttcactcagaaaactgagtgtgaatttagcagtgtgtgaagtctggcatgagaacatataactagtgatagggtctggtgtcagaaagatacaaacagaagatcctgtgtttgtctcctcccagattcacctgtccttcctcccgcattgggttgtactggtggataaggcatgagaggtgggagcagtgatgatggtggctgtagaggctgcccctgttagttcaggccattttggtggcttccttcctatagccatttttttccctccaagatggagtcttgctctgtgacccaggctggagtgcagtgtcacgatctcagctcacggcaacttctgtctcctgagttgaagcaattctcctgcctcagcctcctgagtagctgggattacaggtgcatgccaccacacccggctaatttttgtatttttagtagagacggggttttaccatgttggccaggctggtctcaaactcctgacctcgtgatctgcccacctcagcctcccaaagtgctggcattacaggcatgaaccaccgcacctggcctcctatagcattttaaaaggcaaaccattcaaaacagaggcacagagcatcaacacatgaaggaataagagattagaccaagctacagcagctttctatggccccattatttaatttgtattaaggaatgcacctgtgttgttggaaaaccatgagacgagtccatcaaccacctgctcaccttttcttttcactgtacagcataagggggcttggaatgcaattaaccttatacattgtgaaaaagccgacatgcttcaagcttgaatagaagttcaagaatattaatgacctgcaaaatttgaagaagcagctaaccttggcgatattggcttacgtaatggtagggctagccaaaaattgtgcctcctgtactcactcacaatgtgcagatttgtttgccttgaaagctcgtgagccctgagaattggggcatttaagagtttgaggaaccatagacttatgagcatagagcacttgtggtgttatgaagtagccactagacactcaaatagagaaaactagaatttatttaattaaaagttgtttaattaattatatttttcctatgggataaaactgttcctggtaaatggcttaatcttttcaaagttacattaaatgttagtctggagtgtttttaatattgcaggctcatagagttgtgtatcaagatgtgcccaagagaactaccatcagtctcagcattatatttctaaataccaaaacttgctagtgtcagtagaagaatacatctttttggtaacatcaccttttgctaaaatgcatagtttacactgatatgattggaattaaatcagcctcagttgtcagttctaatcagctgcatgagacatggtcttcaattaatcttatctcataaacattagcattttaaatactttgtcagagtcttgcatacacttttcgaaaattagaaactttcagaacttctttgaggacttcaaaattgtttttgatacccttccaaaataatcttatgttatcttgagattgcattgaatcagagaggagatgttggctttaagacccgatagtcataaacctacatacatatatatgcacatatatccacatatatgagtaatcagctcccaaggaacctagtggtcagcaagacaagggacttgtgtatactcagatggccaaatgtcatggaggtctttatttctcaaactagtcatccccttaactctcctattacgttcaaaggtacccaggaataaaatctttttatttttcttatcaagtatgtagaatcttgtttgtaagcagcaaatacctggctcaaattaacttaggaacattaatctcatgtatgggccagaatgtgtctttctctttcacttgacttactctctgtggactctgtgaggattggcctttgcactctgggtctgtgtgcttgcctaacagtaaatttttatggcgatgaactgtgccacccctctgttatgttattaagtgtaaaataaattgaaagaagagttaaatagtcaaaatgctggaagaacagggcaatagcagggacttgagagcatttaatactcttttcccacttttttttttttttcctattaccttactgatttcattctttcttaatgcaaaacaagtatgcaaacaaggtgggagtgatgtcctcagatgctgctgaaatgtacacatctcatagtttatgccagcgtttaggactgactcatgctttctccagtaccagactcaacaatcctagggaagaaagctcattggcctatcttgggacagatatcaacatggaccaataagttttggcaggaggtaggaccacattgtacaaagttgtcattggtgaccccttttctatgtattagtaaaagaaaaatcactgtgggctggagaagcttcaaacacacgagatgttttccttccctacatggacacatcacctcagtcttcccaagtatggctactggcctcttctggatgtcttctttttccccattacctctagcctgagtgccatttcttttaatgatttggtaaagaacttggggcaagacatattgtagacaggaggagaatttctgggttggtgatttagagcagatctcttctgatcctttcccctgagcccagtacccctcatttactttttggcatgcaggaggaagtggcaactcaggagaaggcagatggaaaggttaaatggtgaagctcacaatctgcttggccaaggaaataatgcccttttcttaaaggctaaatgttttttcaggatgagtggatcagtggagtccaaatattcttgtctactgtaggagatatttgattctttatgtatgtataacatatgtgtaatagttgtagataaagcaattttgatttttctttgtttactgatttgttttcattatccaaattcacttgtatgtacttttaggctgagaaagttttccaaaccattttaacatgcaactcttcaaaaatttactgggattctttgtatttgcttaaataggagccattctgtgttttttccccaagttaatggtgctaactcacttaatgttctaattctgacagccattcagtaataatgcatttccagaggagttgcagtagaattttaagccttgtatttttggctcctacttagttatctaccctgattggcatttaaccattgaattagatttttcttctactgaagagagctttatgagctttaacttcaagtgtctgtgtcacagtgtgatttgtttgcattatgattgacactgagcaagcactttttgcaggaaaaggcattgtcttttaggattgagggaggatttggacacatagtctcctgacacttttttccagggttccatttaatagttgtgcacatcaataacaatctcacctggcacatgttaacatggttactttatttttgcaatcagtaatgatcatattccctgagagctgtttctctgggcctgttgactgatatggccataaatatatccccaaaggctaaaactgtacctgtttcagcacagatgaaataaaaataaatgtcccactgttttagtattacaaattataatctcactacagcatgaactttaaggtggtgatagttcaatttctgctctttgtttttgacatgatggtagaataaatacaattttaaaacattttattcaattaattttcagtgaccattttgtgtgcctggttcattctgtgctctctaaatcatgaaatacatttctttctttcttttctttgcttttttttttttttttttaagacagaacctcactctgttgcccaggctggagtgcagtggcacaatttcggctcatttcaacctccaccttccaggttcaagcgattcttctgcctcagcctcctgagtagctgggattacaagcgtgtgccaccatgcctggctaattcttggatttttagtagagatagggttttaccatgttgtccaggctggtcttgatctcctgacctcaggtgatccgcccgcttcggcctcccagagtgctgggattacaggcatgagccactgcgcccggctgaaatacattatatttcaaaaatagtactacctttagaagttcttacctttaattgttaatagtgaataaacaaaataatgttttctggacctataaatggattttgaagatatccttgccttaaagagaccaaataatatacttgctgtttcttcctattatattatcatattcattcactcagtcagcaaacatcgattactctacctctgggaacctaaaacatactagggacgtatagacaagtaacaagtctttaataaagagttagagaaatcatgacgtaaagtacaatggggacacaaagatagggactggctggttgcattcagggattgctttaactagaagataacacttgaagtaagccacttatgctaactgggtgtgcccagagagggccagaaagaaggccaaaagaatgtgaatcaagtcctagagcataaagcggcatgggcaattgggggaagttgtttgtttaaatttagagtcaatgtgtaagggagtgagtatctagaagtgggacacaaaaaaggtgggatagaccctaatcagagatgaatatgcaaatatatatattttctaaatatatatatatatttgactagaatttgaattttattctagatattagtagttttccaacgtttttggtttacagtattaaatttaagaggaggatgaatattcctgtgattgtcaacttggggaagtaccagaatcttgttgggtggaggacaggggcacattaataattttaaaaacccacaaggtgattgtgataagtccttgtgtcctctccattgagaattattgctatgggcagtggaaaccactgagttttaagtggagtccttaatatcagtgaccccattaaagtactatctcaatttattattctttaaataaaacaattgaaaaatatacttacgtcctccatctctatgctcccatgatcctctatgtaatttttcagtatcaaattttaaaaaaactcatttgttgtgctgttggcacaaacatattttaaaggagtgtttgggaatggaacataaaacagaaatggaaaaaaaattaacattatatatgtctgtctttgatttccatgactgcacatctttgatttccatgcatgtctttgattttcatgactcagagcttttctgagattcctatgggggtgtccaggctaatgggagaagcagctggaggagagtatggcaggccgagtgcctggcacacagtaggcacacaatgattgctagtgtctttagcttctccttttaaacttcagctctttagttgaaatttaggagccactggattttctgttagtggctaatgtcaagagtggctgagaaaaatgtttgaaactgaggagaaaatagtgtctcagatattagacacatataaacattagaagggaatttaatgattgtctcgtatcccagccttctgcttcacagttggtgaaaccaaggccctgacttgacatcacttgagtgacttgacatcacaaggctattaaattacagaaaaggaccagaagccaggtcctttaattccttcatgtctctcagacatgtagatggcatttcttcctgttttttctttttcttagagttaactccatgaaaggttctaatcagcatatctaaaacatagcccttcatgaacttcttcctctttctctactttttgtatccctctattactagaaagggatcccaatccagaccccaagagagggttcctggacctcgtgcaggaaagaatttgtggtaagttcatattgtaaagtgaaagtaagtttattaaggaagaaaataaacaaaagaatggctgttccataggcagagcagcggcatgggctgctcacctgagtatacttacagttacttcttgattatatgctaaacaagaggtggattattcatgagttttctgggaaagaggtaggcaattcctggaactgagagttcctgcccattttagaccatataaagtaacttcctgatgttgctatggcatttgtaaactgtcatggtgctgttggaagtgtcttttagcatgctaatacattataattagtgtataatgagcagtgaggacgactggaggtcacttttgtcaccatcttggctttggtgggttttggctagcttctttaccacaacttgtttatcagcaggggctttgtgacctgtattttgtaccagcctcctatctcatcctgtgactaagaatgccttaatctcctgggaatgcagctcagtaggtctcagccttatttttcccagcccctattcaagatggagttgctgtggttcaaatgcctctgacacctcagtggcatcaacatctaccatgcacttgagctagtcatttcagcatcaattttgtctccatcttatacagtattcagctagtcatcgagtcctgttggtatcactttggaaatgtctctcacatctatctttgcttctatttcctatattacttccttaatttagtctttacttgtttttttttttttccctctggactattgaagtagcttttaaattgggttctgccttctgcagtccactgtctccactgcctctggagttttctttttgaaatataaatctcaatgatgggttcagtagccttcagtggcctttcattctattgaaaagtccttttctctagctgtagcctttcacaatatagctttgatgtcccttttcaacattttcttctgatcatttttctactccctttatctgccagactctgatcacaccagcccattcaatgttcctaatttttcaatgtactttcctgggacacccttcatcacctcagtttgagcacacatcagtgctcaattctatgcatgcgtaggaaaagaaaagttgttttcctctgttctttatagttcttagttggggtggacccctgtaacaaaagacagattaagatgagaaaaacaagtttattaacatgtatatttcaaatatacatgggagatacccagataaatgagtaaatctcgaaagggtagatttgaattcaggcttaaatatcatcttcagctagaacaaagaaagctgttgggggatacagttatgggaggtaaccaggaaaagcgtgagacacaagggtaagattccttatatagatttaagtcagtgccttctccattaatacaagtctctagtgatttagagtcatctttcctgatgcagagagggtgacacagttacaaatagagatttcctttatagatgtaaattttcctacaaaagggtaacttctactctgcttttagagcttctcctgtattttcagtgttcaaaataatcagcttgaaataatctttatgccaaagaggcatactttgggatggcgtattctggtctcttaaatacacatcactttctttgagtcctcctttcctttcttggtcgagataaacagatggatcctctgttacccacagagcactttgtttcttctctaaccatactgagtgctgtagtctgatgtgcatgagaattaattttctttttgaatatgtctgttttattcaatagtttatgaagtccttgagctcagcagttgtatcaaattcatttttatatccttggtacctgtggtaaattgaataatggtcccctgtagatttgcatcttctaatccttggaacctgtcagtatgttaccttacatggtaaaagggatttcttagatgtggttaattaaggatcctgagatggggctattatcttattatcatggtggagaaaggcaggagggttggggcagagaagatgatgtgatgagagaagcaggcatagagaggggatagtcagaagaagcagaggttgcaatgatgtgctttgaaggtaaaggaaggcaccatgagccaaggagtgcatgtagcctctggaaaaggcaaggaagctcattctcccttagagcctccataaggaatgaaactgtgcagatgcttgattttagcccagtaagacccatattggacttctgaccttcagaactttgagataacacatttgtgtaagtttcgagctactaattttgtggtaatttgttacagcagcaataggaaactaatacagtggaggagaggaaaaatatttttttctctacccattgtaggtttatggatgaggcctctatgacaaaaaacagattaacaagagaaaagcatacaaatttatttaataaatttttatgtgacatgggagccttcataaggaaattgagacccacagaaatgggtaaacctgagtatttttaggctaggtttgataacgagtggatagttgtggagaaatatgatgggataaaaagggtataatgtaataggaataaattgaggagaacttagaaaggtctgtttgttcagattctgcccatgactgtcttaatccattttgtgctgctacaacagaatggctgagactaggcaacttataaacaatataagtttacttgtttcatggttccagagtctgagaagttaaatatcaaggatctggcatctgctgggggcctttttgctacatcatcccatggcagaaggtagaagggaaggagagtgcatatgagagggtgagaagtgaagggggctagaactcattattttcttaggaacgtactcttatgataaataacccactcccaagataatgacattaatccattccgagtcacctcttaaagatcccacctctcaacactgttgcatgggagattaagttttcaacacgtgcaatttgggggatactttcaactcaaaacagtggcgcttcatctttagcgacaaggatgttccttttgtcctggtatagggaagcacctcttagatgagggtcaatgatctgcttcaagggaaagttagaaagtccttcttaagttttttgaccagcttcagcggagaagtatgggggcaggtcagagagaccgtcctgctactgaaggaatttttctcacattcctttagccttaaagtttcactatgccaaggtgccatattttgggttagtatgttctgaaccccatcaacagcacttacatgtaacatgcagttgggcttagtgtatttgcatctgaccttgactaatcaagagaattgttctcgatgcccatgatgatcaaagctaacatttattgaaccttttgctgtgtgccagtcactgtggtcaacatttatacttgatcttcataatcactgtatggcaccattattatccctatttggcagatgagaaaactgatgcacaaagtgttttaataattttcccccaatcacactacccaatatgtgatggcactgggacttggaagtgagcagtctggctcccaggtctgtggccacagcgctgtatcctgcttagtcatgttctcatgtcacatatatgcaatttatgtgtgctgtcctagtgtgatatgtcgtgaagaaaattggaagagctagatttgaatattgatgccttcagtaatcagttggctctgtaaatgtgggcaagtcagctaacctagatctgtgtgcctgtctttgttaaatcattccttttctgcttaccttatggggttaatatgaagactgaatgataaatcacatgggaaagtgctttgagaaacagcaggcactacacatatgctatttataagtatatatttggttgatgtagatcttttgcagatttcctcataccaggattacctggctggtctgattcatttggtgagtaggggcttaataatatttggtaaatgcatttgataaaaatgctcttttgccctcctagttctcattcttatattttgggttgttgacactaaaaatctgaaagctcagaatttagtctccttcatagaactttattttctttcctacttttaaaaaaatgagcctttcttatctcactccttagctagtatttttatcttgtagcccataggaaggtacgacttatagaagatttgcaatgatttcagcagcttttcagaagggctttgagtgaacagttaatctcttgagaatgcaaagtcatttgtggtggagaatcttaggccagtgttgagttgcaaatcctggggagtcctgactcaagaagatagggaatttaaaaagaaagccagtgaaatacatttgattctctttttccctgtcctgccttagcctgcaatgttacttattcctttaagatgctttaattgctaattgtctgctgtttgattttgaggttagttgaaatcaccaggatgatggaaggcctgacctgaccagacctgaattcattggcaaattctcaactttttgaaaaattaatgagttttggctgagatgacacctgactttttacagcatcttgttttgatttattgtttcttttgtttacttgtcagatattcccgcccatgacatggatttacagagtacaatttttttttttttttttgcatgttcaaagtcaagctatcctgattggtgcaacatacagacataaaatgatactttgaggggcatccttttggatacatttttgttcctctctcattgtttccctgggatgaattcttagacatagaattactccaggaagggtaccaacttaaaacattaaaatcaaaccaaacaagaaaaagatacatattaatagattgtattccctaaaggctgtactaattaacactcccaccagtagtgtatgagaatgcatatctcacggcaactttgtcattgttcacttactctgtagcatctctggagtactcacaatcttctaggttcagacatttttcagaagttttcaaaatcaccccaggtgatttgaagctgaaaccactggtttagttgataggagaaaagcattctctcactatctcttagtggtttgaatctctctcactatccccttaaaatagatcagtcactttaggtcattggtgtgttttgctacacaggacatactattcctaatgaacagccccttcatcactctaacactcttgaaccactaattcacagtagtgtcacttctaggcttattaatataatcttttgcccatgcaaagctctccaatgttcagataattctgctggatgatgttacctttcaactgaaccacatcatcttgttggcaaagcacctcatgaatactatctcatttaactattgcagggaccttggaattagacatttccattctatttttacagagaaaggaaaaggaacccaaataagtagcttttctctaaggttgtgcaacttataatcacatgttaggaactgaatcaatgtaggtcttctgatttcaagttcagagtttccagtgttgtgtcagaacctgtctttggctttcgctagttctgctgcttttttaatgcacaaatggatctggttattggattgttattaaggatttttttttcagtgtctgcatttcttacgcttattttcttctctgtgtgctcatttagaattctacatatttacagctgtgtttctcaacgtttatttttattattgctcctccttccctaggaaaaaaatttaatttaatttacattcttcctaatgagaaaaattaaatattaaactgataagaacagctactacacttgatcttagccaaaaggctgagaagtgaagagaaattaaatattaaggaataaaattttgacaggtagggttgagccttggaggaccacaaactatgatatctgatgtttttgttcctcaacaaccaattttaatcttgggagttcaaaaatgctgttaatggacacaccaatttagatgactaaccctggctatcagggcagagaggagagctgttgaacattctgatagatcttataaccgtatgtgtgcaactagtggaacacatgacaccgacattactctcagctcacatcaactaatgacttacaaggaagctgtgcttcagtgtgggtggctaattattcaaacttgcattctgtatgattaaaccacatggaatttcacatttgcttttgttttccatatattttatgggtcatatagattatatctccacctttcacccactgcctgccttttttattaaatgtgagctttgtataaggcttttgtctactttttgtcatagctctgggctgaacttttagattcattagtctctgatttgtggcagttacctacatttttacttacaattttagataaataaatgccggcgtgttcacaggcaggaaaacactgcattggtagataagggccattccatgctgggcttgactggttgccaccaactctgacatccctgaccccttggcagagaaagaatgtaaatgagcgagaataaagagccccaggtagcttctgtttgtttttacaagagaaccagagctaggtgatttgggagaatgccagatattataaacacagagccagagaaaaagaacaaggatggcaagaagagtccagggactgggggaggtgcacttgcagggggtggaggttggcccagaggaaggttttcattcatttctgtgtgtagaatttttaagattaacttgctaatttttttattgaagtcaagcaagattttaaatcatttatcagggctcatagagtacctatttatagaagtcagaataaaagtaaatgaaccatgaatgctaacacacatctagcaaatttagtaagatttaaaagttaaataaaccaatggagcctgcagattttctccagggcccctttacaagttttaactttgtttccattcccccccacttcattttacacactgtcatgtgtgattcttttagccttagcttttagaatacgaaaatgatttacaagcctgtttttagaggctatttcatttttagttaaacgtttacatgatgctggcttcctatgtaactgctgaaaaacaaaagttttttttttcttttttacaggtgctagactgtcaatcaggataaaggagattgtatgaattatttgttgttgcataacaaattgccacaagtaaaacaacaaacatttattatctcaaattttgtatggcttaggtgggtcctgtgcttcagggtctattacaaggctgcaatcggttgttagccaggacagggatctcatctgaaagctcaaccgggaaagatccacttccatgctcccatggttgccgcataatccagtttgttgagggcttttggactgagggcctcagttcctaactgctttggaggccaccttcagttcctggttatgtgggccttctcaacattggaacttgcctcctcaaagccagcaagagatagtctgctggaaagacatccaccatctttgctatattctgttggttagagagtcactagaacagccgacactaaagggcaggagattacacaagcgcattaacaccagatcgaggggcaccttaggatcctaggccaaggagatatgtgactccatcccaacaagccttcaggatcttagattctttgagggaagagacctttttttcgtagttaaaatatttacaaaacctttgtgaggtcatagctagcgctttgtgctgaactggattgtggagccctgggctagcactgtgcagggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtgtgttagagggaaaggaatatattctggttctggagattttcagttttctttttatctcattaattcctggctgggtgttccaggacaaggtatccaaaaagccttttttgaatcgcaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcaggtgggtgagtattagacatcactcaaggaaggcttcctggaagaggtgacacagagttgaattagttggacttaacctttgaagaaatgaaggcaggctttgctgggaggcattggagtattaggtataaaggtttagaagcaggagagcatttgggacctcacaaaactgcaagttgttcagtatggatggagtttaggggacttcttggaaagtagtaaaaattgaggctggagctgggtgtggtgatgcctgaaatcccagctattcaggaggctgaggcatgaggatcacttgagcccagcagtcagaggcttcagtgatctatgattgcaccactgcactccagcctgggtgacagagtgagaccctgtctctacaaataaaaaataaaaagatgagactggcaaggtaggcaggaataaaatgatcatcagagttcttggatgttgttccagggattttggactttaccttaaaggaatcaagggataatccaatcagattgtgctttagaagtagagaaggattggaggggtgttaggcgacaagaagaccaaatagtatgtaggtgaagggagagggggtctaaaatacagtgaagtcagaggaagaggagataatgaatttgagatcctaaagatgcagaatcatcaagacagggtgatggcactggttgtggagcgggaaacagaggaagaagggaagcttgacttagatttctgactttagtgactgggtagatggtggggtgactcgccagtctacaaaatattgggaaagtgatacgtttgagtttagttttggaattattaattataggagtttgtaggaatctgagcagagatgagcagtgtttcagggtgtccagatctggagctcaggtgaatgtggaggagaccaccaggggagagtatgcggacccagaggagaaatagggtgaagggtgagtgcctgtgacatctgcagttagaggggagaggacactgtaagagaggaggagaaatgagtggtatgataatcaaggttcccggggttacaggccacgggagccaacacaagctagctcaagcaaaaacacactttttagaatttaggttatcaaaggcactcaaggttctggaactaggacccaaaaagtctccaggagcacagcaggcactctgtcacactaaggtcctcatattgcagcaaggctgttccctttttctgtctaaaaaccatcttcctccattgctctgtgtgggtgacatacccacagctcctgagttgaagcctcctcagataatgagatctcccatccaattgactgcctttcgacctcaactccagttttctgggagacttagtctagcgtttcatcttggaaaggtgcccatggtgtcatgcaatacaaatgtggctaatgagggcccaccctggctgtagtcagcccttagagaaagaaggatgtagttagaatcgtatctaccatgggcagctgaaatgataggaagacagtggcaggaagaggggtcaaaaaagccagacaaagggagagattcaaagaggagggaggaagtggtccactgtgctagatgccgctgacccaacagaaggattgaattcaggaagaaaaggactgtgagtccatgactttgagtagctaagtttgtgaaaagaagtgggaaattgttggttttcatttagacgggtaaggcataagtatgcttctctgtgggggaagaggaggaacaggcattaaagtgggagggtagacaatacagctgaaggagggcataactgatggttgagattcccgagaaatcaagagggaacagaggtggagcgattagcagcagacgggaacgggccacggctctcaccaaggctggcaggaaagtggggtgcagatgtagataatttggagggtgagctgctaagaaattaagtccagattctggtgacaggaattatttactctttataaaaccctaagttcttcttttgctccttaaatgtactgaataaatgctgagaagagcaatttaaaggtctttgacaactgaagaatctggtattacatatgccaggggattgacacagagagcttatgccaggccaggactccttataggagccccaagttgggcccagtgtccctgtctgaagtaaatgctcctgtgttcctgctgtggtctgtgttcctccagaatccatatgttggaacttaatttccagtgtgatagtattaagaggtggagcctttaggaggtgatttactcatgagggtggagccctcatgagtgggattaatgaccttatataagaggcgtgagggtgctgttcatccctgtttccctcccatctcttttaccttgtgagggtgagcaacaaggcactattttggaagcagagaacagccctcaccagacacggaatctgctggtgccctgatcttggaattcccaccgtctagaactgtgagtagtacacttctcttgcttataaataaattacccggtctgtggtatattgttatagcagaacaaacagactcggacaattcctaagtaagttcaagaacatcccatgagaagcaaacataaaaatatgaatgtgtcactccagcctgggcaacagtgagaccctgtccctacaaaaaataaaaaaatgttagctgggcatggtggtgtgcacctgtagtccctgctactcaggagggtgaagcaggataattgcttgagcctaggacttcgaagttacgtaagtgagctatgattgctccactgtactcctgcctagacaacagagtaagaccctgtctcttaaaaataatgaacgtagctaatgacaactgtacaagaattagaaagctttgaggttgtctttctcctgtcttcttgctatggctttcctctcctcactgaggctgactctttttataagtgagaggatcccactctgttgcccaggttgaagagcagggggcgagaccatggctcactgcagccttgacctctcagtctcaggtgattcttggttgcatgaacagtatagggctgggatcctgtgcaagatggccttgctcccaagtttgtcagctgtcattggcaaagcacgtatctaaggatgtctggcccaaaatggactcatcctctcacccaccactccatttaccagaagacctggaaggttttcttccatgcatctttagcaaggctaagtgagaattactagcatgggattcaagagaaacttaggtttagtaaaaaagagaaagtggacgtatatatcattaaatattctaaagcagtattttttcctctaagaaatcttctggtttagtttaccaaaaagaggatgggatgatggtgatgttacccaagttaatttatgtttcaaatggaagaagcaagcaggttttttgtgtgtgtgtatttaggaagcagaaaccatgatttgtgggaattctttcatggtaatagtcaccagcattttttgagtgcctcacacgtgcctggaatcgtgtcgtcagaacccgtgcctggcacttagcaggcgtcaggaggcacaggtctgctgatgcacttaactagtgtttgtgctaccagaggatgcagagggcagactttccagtaagaaatgggatgagctgtgagagtagcttcgtcaaatctgccatactttgctggagtgtccatagtactcctatttaatcctgattttaggcctagaaattctctgcttgatctgagggaggggtattggaccatcgagggagcaaaaacaagtccttaagcccttccacctgcccctccacagaggcttccaaaattccaaacccaggggagatggctctttgaccttcaggtggcacaataacttataggagagcggaggcattccagggatttgctgccctgggatatttatttgaataggtccttattctggacagaaagacaaaattaaggactatggcttgaaaatagagatttgtcagccttcttcctgggtgaatagaatgttcagtgggtgcaggtgaggctttatcagacttcaagctgccgcagcacagcccatcctcattaattcctaatacttgcgatacaactctatcagtaagaccttacgcctgataaagtcccgttcctctcttaagactataaccgtatactttgcttatgctattgtacttttgtcactttgaattccctgtttgaatttaaagactggtctctttgactaaatttccctagcagaatatccagattggttcaaagcccatgagtagaggcagtagttcctcttaaatactgttgtcttaaatactgagggacaattcacaaggacaccttcatctggggtgttgggtgcatttcattctcacttttaaattaacaaactattttgggaattgagacatttgacattagatgactccaggatttcactgtcttaaagctggtctaaacttgcagagcattcaaagaatttggtttagtttaaaaaattattgatctctatgagccaatgtatataatggtcaagaaaagacaatataaattcattgtaataaaggctaggatagtagattcctgtgaagagggtggggatgggacaggggcataagctttctagaatgctggaagtgtttataacttgtttcaggtgttgagttacacaggagcatacaaatgtaaaaattcacagagctttatttacagcagtgaaaaagaatacaaaaattttcatctaggggttgatcccatcattccctaagattgcaggcttcattacaggtcctcagtgtaaacctttctggagttttaagatcctttagggagttacaggatcagatttgtgctttgagtagctctctctggttgttgctagagaaagggttggaggggactaagtgagagcagtggccatggctgggaggctgatgctgtggtcagcaagagagagcaggcccttgattagagggcaggcaaggggctttgtggggtgcaggagaaggtgttgagggtgactcccaggagtcctataggagcagttgtgtggagggaagggccagtgcctggagatcaagaattcagctgcaggcaagtttagtttctaatgccagtgagccaccgttgaagatgacaagtaggtaattaagtagatgagtctggagtcagaaaatcagtctgagctgaagttataaatttgggagttgctggcatggtatttaaagcaatgagaatgcatgaaatcactttgggagagagcatagagtaggaaggaaaggggttccaggactgtgtcctgagaaattgccacatttagaggtcaggtaggggaggagtcagaataggaggctgaaaagggatgaaaggggagtacaaggacagcaaggagaccgagctgtcctcgtgtccaagggaagaatattacaagaagtggagagtggtgaactgtggtgagtgttgttgaggagtcaagtaagtggaggactgaaatcctcacttggatttcatagcatggaggccattggtcatctcagcaagattggcttatttggaggtgtgctggtagaagccacacggtagtgaaacaaagctgtatgtgtttttcttgcaggttatttgttgctttagtcatgtattcaaaatatcaatccttcatgtaacatttaattgtataagcttaattctattatgtaatgtaaagagattaattggaatctagtttctttagctattttagtgaaagacattgaagatagaaagttgctgtgggaaactatttttgtggctttatatttactcagttggatttttaaagaggtcattttatggtccattcctgcccccatgcaggaatgaactgcatgataattgattcatattgctttaaagggcaaagtattgagggaacttcttgggaaatttagattttgtctagctgatcctgaggctaagtatccttggaggctaaatggccagcatcttttcttaaacttatggaaatctcaataatggaaagaaaccagggcagggaaggctcacatcactttatttcagaagtcaagcatatggttttgttgactaaaatacatagactgagaaaaaagaaaaacaaaggaaaaaagtctcaattatgttcaggtctggagtttaggaagtgttttgtgaatacgatgcatcttatggctttgtatttgatgtcaactcaatgtttagtcgaggttgaaaagtagagtagatgtgtgactttcctacttcctgtgacacagtgacatctagccctggatcctggtgctccatgatattgggaatgaaggcaacaatttgagtattatctagatagagcccagcaagtagtaggtgcccgagtgatattgtgttgaataaagttacactgaagggaagtctgtccctgacaatctcccttctcttgtttgctgagtcttaggctcttaagagaaatgatctatattaattttctccttattcttgcatttaggaggttctcctgagaatcggaaagtccagtctatagtaagtttccctctgctggtgtcaacagggagggttaacatcctgcttcacaggaaggtagcacatgttaggcttttactatacatggttaatattttcaggatgaaatttgattttacagcatagtcatatttatgcaatatgatattataatacaattatgaggaaaaatagtggttttgttttgttttgcatgcaaggaaatgtgctgggatgaccaggaaagaaagcagtgaaggaaacaacttcactcccactatttgtggagcttgtttggttctggcaggaagtcagggtttcagaggagatgggatgttcagtttggtccaggtgatcttcagtcttcaaggatctagagagacttgggggttgtccatgattcatcagaagagctgtttcacagacctcagggtttgttaagggttagaatcacagtgccttcgtaaatttttcttagatggaggtgaaggtatgagtagatttattctgaaggtagacaaaccaggatttaccttgatttcttgagtatttttcatcagcgtaaatgaacccaataagtaagtgcccgtgggtggcactgtgatttttgatatacagttggtatcaaactaattgtaatgggtcttggcgagatgaagtcatggactgtgggaggtaggtggggtgtgagtggggaacacttgagtgagaggtttcttttcctctgaaggaatgatgatgatgataatcatgcctactgtttattgaatgggcactgatgtggtcctgccctctgtattggcatgacgaaaataaagctcagcaagttcttatgtgttctttgaccctgaaatcccagtggtctaaaaatagatttagaaaatacctttcctaaagagaatcagaaaaatgtttggggttctcccaacattttctctttgtatattcttgtttctctgtttattctaccatgcttttttgtgggcccattgctataactgttaccatgacatttgaaattcccaagtgctataaagagacagtgttgttattattgctgtttgttattttttattattgctgtgattgcagggaggcaaggaactgggtttgacaggtggaagggggaattccaacaagagtacgtctgggatgatgggaagctgaggactgggatactgagagagttagacaggatgtgactaacgagaacaatgccatcaatatgcaaagcatacagaattgcgaatctgattccaaaaatgctaccactgcaaaattacaatagcagcgttttcttagtgcataagccaagtgttattttagcctgagagaaggcagctgaactggagatagtgaacgcacctaaacaaatgtggcctgggatgaagctgcaaaaacacaaaagggctgcatgctggcatggaaaccgcctcagagctgaaacaacagaagctgaagttgagcagtgtcagcccgggatgtgtggtttgccctgggtctgttttggaggccttgggaaaacagccctacagataaattctccagatttgcggtctaaaactggtacaaaagaaacagctctgtctaacttggcaagattgaagagctttctggtggttaacttgcactgtgcatatctatttgtatgccctgcatttcatctgaatactattaaaataaatggaattagaagtccctcacccacgccattctgagcccagaacattttttttttccattgccttcttaactctgctcagtaggggggtcttcctagtttggaaaaaccactgcttggatgttctagaggaggggataaagaacaaggtcagataaacctaatctcctaatctcccatctgtaaaatactactaataataactacttcatagggttgttgtgagaattaaatgcaattaataatattgcaatttaatataaaattcattatcattagatgccatacatgtgtagaagatctaataaaaatatattactgggtactcattgtgtcttacccactgtttcactgtctttatatacaatttcttatctgggataagcaacttaatccagggacgcatgtaaagcttataaagtgtagaaagatttgaaatcctcagaactgctggtaaagctcacatgtaaccattgctactgttccctaatttggaatctggcattttgtaggtgcagtactgactaaattcatttaattaaatatggagcaatccaaagctcccatgttcttttctcctggttttatataaactgtctacagtgcagtcaccaaacctttgcatctcctttgtcactgggatcaggagatagcataaaatcagacttctgctgtatatggttatacatatatgagccatctcactatagggctccactgtcttaaccagggtctggactattgctgctaagaaaactgatgacccctggtttagaactttgtctaacaacaaatgactttgaataggcaagtggttttttgtggtgaagtagatgactcttttctttcttttttccttttttttttttcttggaaacatgcggagtgatgttgtctgtcaggtctgctggcaggttctgttgcaaggagactatgcaggaatctgcctgcttggcttaatcactggaaaaaaaaaaacacaactgccaagcaagtcccaggttgaagtgggcaccgcacacaggagctgctttatcagacttaaagggatgctgcgagaggcaggagcacttctcccagatgtaggctctaaccttgaaggaacagtggctctcacaggcccggtaataatgtgagcataaaaaagcaaagtggctgggtgcggtggctcatacctgtaatcccagtatttgggaggccaaggtgggtgaatcacctgaggtcaggagtttgagaccagcctgggcaacacggtgaaaccccgcctctactacaaatacaaaagttagcccggtgtggtggcacacacctatagttccagctactcgggaggctgagacaggagaattgcttgattctgggaggcggaggttgcagtgagctgagatcacaccactgcactccagcctggacgacagagcgagactttgtccccacccccccccccacccccccaaaaaagcaagggaaactgttagggcacctctgatccttccagtgtctgtatctgtgtttgctggctttatcattactcttgccctggagcctcctgcaggcctcatgtgtattcatcgcaaatataccatctccaatgtgcctggcatgaggtcaggccctggggatccagtaatgagacatagttcctatctatatattgtctcttcctttttctatgcaccccctaaagctggagatgctgttttacctattcttcaaaagactttcctagctatgtgtaactcatagtaataatcaagggagtatctatgattaataatatatatattttgagacagggtttcactctgtcacccaggctggaatgtagtagcacaatcacagctccttgcagcctcaaccttccctggcttaggtgatcctcccacctcagcctcctgagtagctaggattacaggtgcctgccaccacgcccagctaatttttgtattttttatagagacagaatttcgccatgttgcccaggctggtttcgaactccttggctcaagctgtccacctgccctggcctcccaaagtgctaggattacaggcatgagacattgggcttggcccgattaaactttttaagaggacttgtcccatcatttcatgttaattctcctgtttttaagtagtcagtttagtagcaatattttaacttattctaatactcattaatttattaacaaatatttttggatgtctcttatctgtaaggtgctatgtggttcatgtttttgatgagtgattattttcgtttgtacagatcgtttaaatgagagtttgcagaagatgaaaggggagtcttgcattcagcaatttgccctgtatttaatgagccagccaccttgtgtcttcccctcctatgacatagcccttcagctcaccctacaattgccacatgaaaacttctctcatgaaacccacagggtcagtatctctcaaatactctttttcctccacttctggggcatgatcttgcaatgtactccttactgccccatcctggaaacttgtgcctatatccttgttttctatacagtgtttagccaaggtccttgaccggaatatagatcacaaaaagtactggttgtcaaatgtcaaagtaactgacatttaacagagagattatatttgaggatgccaagaattagcaaacatttttttctgatcatctcaggctatttgaagaagttatgaattcaccgaattgactgaaacctgccctctgaataattcttcagcactatataaaccaaagtttgtgttggttcaagcaggcaggagggctgtgcatctgtggtatgggagccccctcaactagaggctagaaaaaaacagcatttatgctgcagctggttttggtatcagatgagcagctttaaattgggagttaggagaactggaagacttgagtccaagaggaaggtagttgaagcagagatggctcagaaaccactaggatctgtgcatcaacacctgcctcaggtctttatggacataactgctaaacctttggaagcctgaggtttacaaaccacttaccttaaatgtttacgcttaaattttaagaaaaaaattttaaaagtttaccaaaggatgctcaattcctggaatagaatagaccttcattttacaattgatatttggaaaaaattctgggttagttcctattagattcaatgaaaatcagcagtggaagaatttattctcatgatcgtgattgaacttaccttgggtgggtgcttcagttctgtgtctttgtgtcaggaaaggctgtgggctggaaagagccctgagctcagctgtgtctcatgtcagccatgctccttcagaaccacagaataaggcaaggactagacatctgaaatcattcacagctaatagctgtaattccatcatttagttcattaattcaacaaatgtttatcaagcatcacctactaagtgccaggcatcttcctaagtgctagtttacagcagtgaacaaacagaatccctacccttgagaagcttcaatctgcagcatgggtgaaactgacagtgagcaagataaatcagtaaacaacagtagatatcagaaggtgagagagaagtactgtagagaactccctcgaaacagagcagaggaacgggaaggatttgcagttttcgataaggaaagcttccctgagaaggtgaccttgaataaaaactagatggaggtaaggaggcaaatgccacaggtatctgggggaatcttcctgacagaggaaagagcacatgcagatgccctgaggcaggagctagttggcaagtgtgagaaatagcaagcggtggaatgatcctgaataggagataaggtcagaaatggggagcgggggcagctcttgattatatagtgtcttgaaggactttgttatacctctggattttactgagtgaggaagaaagccacaggggcgttctaagcagagcgaagataagacataacttatcttttaaaagaatcactctacatgacatgctaagaagaggctatagaggcaaagcagggagcccaggtgggaggcttatgcgacattccagacaagaattgatggaggtggtaaaggggcgatccatttgaaaggtttgcatatggtaagttgtgagtgtgggacaaagtgtagagtcaaggatagtccaagcattttggcctgaacagctagaaacatgggagtggccattaactcaggcagggtactctgtgaccatagcagatgtttggagactgaccagttattctgttttggacattgaaagttttataagggcatgagacctccaggagaaaacgttgggtaaacagttggatacagaagtatgcaactcaatgaagacatctgggataaaaatatatagttgagagacatgagcatacggatggtatttaaagccatcagcctggatgagcacaccaaggtatgagtgagaaagaagttattgaatgaagggtttaaggactgacctttggggtactcaattttgagtctgggacacagggaaatagcaaaggaaggtgagaaaaagcaaccattaaaagagaaggaaagccaacccagagaagagtcccagaagccaactgaagaagaggatatgaagaagatgtgatctgctgggtcaaatgctgtaaataagatgacaactgagaactgagcagtatattgagcaccgtggacatcattggtggccttgaggagaattgtttgggtggtgtggtggggcagatggtttttggagggagttgacaacaaaatggaagaagaggaactggagacaagtgtaaagactcttgaagagttttactgcaaaaggaagagaagaatagtctggtaccttataggggaacttcagtcaggaggattctgttttgttgtttggtttggtttttgcctttagaggggtgaaacaacagtatgaaggtttattgctggtactgatgtagtagagagcaaaaagttaagatacggaggggagaattgctattgggttgctgagtagggaggaagagatggggtctgttgacgaggtggccctgttttaggaatatagttcatcctctgtaacaggaggtaggcagagtgtatgggcaagattctcacaggtagagagaggtggtggtgagaccatgtgccagttcttttctgattgcttcagattttttagtgaagtcagaaaacaggtcaccaacaaagagtgatgcttgggtagaaaatgatagaaatttgaagatagagaaggaagatagaacattgtcatcaaagagagtgagagcacgagtggactaatgtctaatactgcagactaaattttaatggtaacagtagatttttattaacctacatttgtcaatgcttttccatttaccaagtgctttctcatatgttggttgccccaacaaccctgtgaagttggcagagagttgggtgttctaaaatcacacagcttgaagtcaaagtgtggatctcaaatccaggtcatctgaattgcagtatagaattctttccttctgttaatattctctttttaaatgactgttaattcgtgatgatttccaggtctgaatgtactcataggatctcttttttccccttatgtgttttattgctctgaatagtcctagagagaaaagatcagattaagtattttttgttcattactatgaaatgttgagtttcaccatttttcagttatagtccagtgtatagcaagttttaatggggacaaagtccttgcagagcttaaaaatgaaaccttcttaataggaaaaacataaccttgttaatggaagttttggttgctttccagcccaaaaatacatttttagaaatatattaattaacactagaagttataatttccttaagtgcaaagtattatcataaataaggttgaggaatatggaattgctcttcttaccttgcagtcacatctcatacaatgctaattgtgccatacgcataagtaatattgggttaaaatatctctcatgttcccttagagatgattagaatttttaggtggaaatattttcctattgtattagaagtcatttaatcagtcttaattcatacatctcctcaaaatgcctactcttaaaatcaactctttggcatactccgccatctgaatatttgctcatttctttccaccttttttcagacttgattctgtggccctatatcatgtttgtgaacctcatgttgacgtcagtcagcatttcagttcagtattactctctataccataaatcactggagtttctaagtctctcattagcttgattcaaatcttacataagatttagttagtgtcagaacaattcaactgtgcacaaattctggtcaaacaaaaactataagaattgagatcattttagaacatctgtagaaaagtagtagatttgatagcctattataattctgttagctcattaatataacaaatttatgaaaatattgtggactcttttctagaattctttaagatagattaagttttcttatagtacttcacatatggttttgcctggataaaaggcaatatatctagaatctttgatctcttacaatactctccaaggaaaatggtcagaataaaaatttcaaatgtcaatatctggtctataaaaaattctaataagtgctttttaaataaaacatttcaatagggtatttttattgtggtgaaatatatattgcataaaatttacaattttaactaaagtgtgtaattcagtggcattaattaattcagtgttttgcaactatcaccactatttccaaaaccttttcattacctaaacttaataagtgcttttgaaattacaggaaaatattaaaacttttctatgccggttgactaaccctgaataatgccttgagttttaataggtcagtaaaaatgttttgggtcaaaaacagagtgttcattttgtaatatttttgtttcttactaggataaacttaaccacatcttttggctcattgattattgttaaaattcagtttttttggggggtagggtgattgcttttgtgagccttcttttaatcctttttatcagagtatcacaaaattaaactcaacatctgtttaacatcagagagatttgatgatcatgtgcgttgccacatgtacagtccaaagatgaaactcagttcagtttaaagagactccaaaaacagatgactaaaggaaacagtacttggaaatgggagtgagagaaacattcatcttactgagtcattatgggtcaaagccttccatgtactgtgtaaaaaccatagaaagaaccagtttggtaaattccaatgaagtgatcatacattgagcacatttataacttttcaatttaaagcattggtccatttgcttttggataatagtggggatgatttcctagtaactgatgatatgtactagtaagtaataaaactgagtttccctacatatggtgtgtttgttataacctacacctctttcttcacctataaaacacatatttgcccctaaggatctaaattaaatactttgttttgtgaagtcttcctcaactcccatagacagtcaatcagtcttcctttggtgttaataatatgctataagaaatacatattatagcaaacatcacattaaattcctgttttttctacactgtgagctgctcaagggtagaggctatcttttattcctgcttatattctcagtatagttcatgttccatagtagaatcccattaaatatttgttgactcactatttgaatggatgaactgatcaatgtaagcatccatactggagtcttcattttttaacagcatctcaattataagatgttcatattttatttactaaggcaattagcaaaatatatatagggttcagtcgtatgcattgaggcagcagacatttccatttatgacataagctgaaggcaaagtattcttatcacaaactcctgggcatttgtcagtgcctgtagaaaactcaaatgacatctgcaatagaaatacctggatgtctgtgtttgttggttgtggggtttgagaaggcattacagggggatgtgtctcctccaagttgcctatgctagactgtgatatctccatcatctgctttgttcctgggcaaaggctcagcactggccccagtcatgggcactggttgggggaacattccatttgacatggcgcctaccacagaggtgtgctcgtgttggcactatagctgttaacagtaccacagaggtaatagcacagagggaatagcctgacccaaggtgtcaccatgcatctctgtgactagacagtgggacttcccttactcctctccaggctctgtttttaaattttttttatttttttattttattattattatactttaagttttagggtacatgtgcacagtgtgcaggttagttacatatgtatacatgtgccatgctggtgtgctgcacccattaactcgtcatttagcattaggtatatctcctaaaactatcccttccccctccccccaccccacaacagtccccagagtgtgatgttccccttcctgtgtccatgtgttctcattgttcaattcccacctgtgagtgagaacatgtggtgtctggttttttgtccttgcgatagtttactgagaatgatgatttccaatttcatctgtttatggatgtagatggcatttctctaccttcagtagcttcgtgggaccatcctttcatttcctctcctttcattttatctctcttccctttgtttcccttctgattcctcctttgccctgaaggaaagttatgaagctctaggtggcagagtgcaaatgggtaaagatggggtgttcattagcgcctgatgtattcactgtgtgtaaacccagcctacccatctcagagaccacctttgcctgaaatcctctatttaacatgtggcattcagagcagaagcgtctgaaaggcacatttcttccactaaacctccaagaggacaaacccagcaaggacatagtggatttatctgagtttaatggtattagcctgagaccagccatgatgtgccaaagacattggcaatttggaaaactaccaacagagtcctaatgtcagtcatgtctgtatagggctaccttggtgacttttttgctaaaattcagggacttagctggtctcctcagccaggcagttggagtgatttattttctgggactgaaatgaccagtggattcagtgaaagcaattagactgactttgtatagatactggaattttcctttcccatgattaacaaacagagtaattaagcctcgtttgtttgtgctcattctggaacagaacagctatggcaaagggggaggggaaaggggttgacttttctctggcactggaaatcaaaatgcacatttgtctttgtgtatacagaaagagagggaaaaagagaacaagaggggcagagaaggagagaggcagagaagaagtgaggcagagaacagaaattacctgctttagagagtggagtggggttgggactccctttccaggggttggaagattaaggcagcacttgggtctggaacactgctactgttccccaggtatggttaaatagatacatcttggcaacagattcagaatccccccccaagacctgtaattaaccgttacaattgcctatgttttccaaaatgaaaatttccttaaaacttaatccacatattttaaccttttaaatcttttgtaaagagataaatagcatgtgggggaagttaccccttcttgaagaatgacgattaacctgaactcagctataattataaggaaaggagaatctttagaaaagcaatggcagggtactaggttttatatcctgttgtacctagatttagagtattttggtttccattacagctgcctgagcatttcttcctctgtgtaagatgatttttagatttctcattcaccacatgctttaaattttaataacgttatagacatggaaggtcctgattttctgcctcttaccagtctcatcctcttacctcagctgctagaaactgttctctccacagtaagcctgtttgcatcctaaagccttcagcagtgagggtggaaatgggttcttgaatatcaggctcagagtggggacctgtgacctgctttccagatggaaaccatgagagccgtgcatgtagacatattcccaattgctgaaaacaaagaggtggtaagcacaggatggtgctggtggcgaagaaccatgtcttctcatttaacaaagactattcagaaaatagacattttagaacaaatctgaatgctaatagaatttctgaaaagggagagaatggatataaagtatactgtaatcaacactgggaagttctggtagaccaaaatgaatgtacagtttctgtgtggcagcctgcagccaagccagatggctgacagtgggccttaccttcactacctcttgagtatagacaatgaaaaaaattgagaacatggaaagagttttatcaagacttggaagatctttaaatcatccttgcatgtagtgcacaatcatggctcacacaccagctatcttgcttcccagttatgaaaatggagcactctgtccccacccccaacatgacccacaggaatctgtgtctcctggaaaggctggggactgcagtggccattgagaccaagtggaaaaaaaatctcagtgcacccagcaggccacttctctctagcaatatcaaagtgtgctgtttaggaaagccagcctcttccttagtttgagatcctctatttttatataatattaactctcatttcaatgtgaacatctgaacaaaaagttttttccaaatgaatagagccaaggggagatattgtattgagtgtggacagcagaatgagaaagaaaatgttttagtacttctagttccatttagtcttcttgatacttttctcttaggccaaaccactttgagtaacagaggtccttggctaagttccaggtggaaagaagcaaactggcattcagttccattctctttctcatcttgcccttttttgaggtagcactgactggtatgttaatttcactggttcatttttcatttaataaatatgtacctaagatttacttcatgggaagtgctgtgttagatgctagtgatgcaaagattaaaaagacaggttgcagcctggagtgactcctttgggtggaattaaggaagcatcaaggaatttagcaactcagtgggaaaggattggggtggagttctagagggggaatctgcttgagctgagatagggcagacaatgagcacgaggtgctcccagcaaggggaataggtcagacaaatgtgggtgagtgagagaatatagagggagccatgaagtaaatgatgaaataaatggagaagatgggaacgtgtacttttatcaagagttggagcatcttctcaattgtctttgcatgtagtgcataaaaccaaggctcatccatcagtcactcttggcctatggaaggtggggtctacatgaaatatgaccttggtgttatactaagcagttttgacttctaagtatttggtagggagcactgaaggatttgcagttgggacttacatgtccatattttcattttggaaaatgtattgtgaccctcagttctaaatgaccgagccttacttaaatcaccttatgcctaaaggaaattttgagtaaagttgaaatattctatgtcttctaaatagtaacctaaatttcatttagataattaaatatgtgtaactacctttctttctctctctctctcttttttttttttttggtctaagttggtctacagtgtctgaaagagttgaatggatttctttagaagcagaggaagtgtactttgatactgttggtgtgccatggatatacaagggcgcagggttagcctgggatgaatcattcacatgaattcagaaacattgctattaaatgaaaaaaatgtatttattatagagtagaatgcaattggcatgttttaaaaacaaacatgaggcatgaaggaagtttctactttgggctgaatctcaagcccttttgggtgggtgcctgcagtggggttgtcaagaagactgagaagcactgggctctgttgttgagcaaagccaagcacaagaaggtccttatgcaaagatggtgtgtcaggagaacatgtctgggtgttagttaatgcttgtggaactctcacaactccactagggggatgaggagctgggaaggtgggggttgtggtgggagggagagtcgtaattcttgtttcaaggcctggcttcttttttacaagatgattagctacatttagaaacctattctttacacattcttaattttgctggagttggaatatcttttcctcttctctgtgttggtattttatgagcagatcaactcaatctgttttcaataacattcaagttaatagtactatgacttagatgaaaagaaaattaaaagttatcaacagcttggtatacttaacccttcctaatgctgggcacattggctctcctttcctggatggactgagaaaattctggaaagtagttgcccaacaaaataggttagtactgtactgcacactttgttcagctttactgtgggcattgtcagatcaggttacagcataggatttaaaggtcaattatgccatgactttaggggaaagaaagagtgactagaaggttaaaaaaaacccctaagttttggcttttaaagacttatgaaattgtattccctttgtgacatttgatgaatcacttttcttaatttccattctgataataatctccctaacgttttcctaggaagctctttcatggcaaaaatactgtcctgtagatgcccgagagagttggggccagttatacagggtgggggagagttggggtagctactcctgtctctccgagttgatttgatactgcttccttgaatttactgaaattaagacacctgaagagattaaaattttgtggcataaaaacagtcacagctaggcatggaactggtttcagggagaatgaccaagttaggcatttagaggatgagaaccaaattacagatatacgaaaattagagaagccaaaatgaccccatgcattaatgaatggcctgagggaacatctgtggttgtctgcgtcttagcttacaaactgaatccagggacgttttcatcacaatgcctgcatctgaatagcatggaaggtcaccaggattaagagttttgacctgtcagcgcaatggggtttaggtttggtatctttatttttggtctgtaagctcttttgttcaaggcaaagttgatctctccctgagccaggccttgagtggaggtggactggcttcgtgtttctaattagtcagacactccccctgctcctgactactgatggatgtcatgttagttcaggaccccaagccctctctctctttgagctgcagtgcagggatccactttagtactgaactgtcatttgtatggttagcatggtggccggctgtcttgagattatgttagcagaccccctccctatccctggctcttgaccttttagcatacagcctcttggcattttcccaaatggaataatatatgtgtaagcacattgaacagcattatatgctgtttgctaatcagatgtggttgactgtaattatcttgcattcagttccttgttggtagatattctgtacaggtagttcattcgtattttggatcttgattaattttcacagtgccatatattgaccttgaaagaagtcttggtcagttttgaaaatctttaaccatgcaatggttagtccttcagccccaccatttactttggctgtctggcctcttacctgaagcatcttattacttgatctctacttcgaatgatctcttttccatcctttgggaaggacagtggcccttgtccctcaggggagaccctcctacatgctgtagctgtgaagctaaatgctcactggttcttactggtttaggggatatggggaggcctggcttgtcctggatccctatcttctactcatgcagtacttcctgtggttccatttaattgtacatttgtatgttggtcatttcaaccttgcttagtggccctctgtcctacttagagacagctaacttttttggctttctggaaaattccttgagatttgttgcagcattgcccactcctcagtcatgtaggccctgcctgtactgcttatcctagcttacattttaaatctcagtacctcaattcttatgatagccaattctatcttagtattatgacttcttgatgtccagcagaaaatattgcaatccattaacacacagagtagtgtagacagttaattgaatggaaatattactagatgtactttatagatgatgaacagattatgacattgtatagatataattgggttcttccttggagagattcatcaataataaaaacaacttttatttattgagaacatatgctggattgcataatgctctaaatatttcctctaacactttcaacctgtatggtgagcattggtatccccattttatagaggaaggacatgagatgcttgcctgaggtggaatcagtgttattgtgccagtatatctgacttcaaagtcagttttccattaggctgtgtggctatatattcacaaagaagaatcctagtggtgataattagtgacctactattggcaggagaagacactagcattctcttgaatgtacaccatatttgcttgtcaactgattgatccttttttgttatctgccagacgctgacatggtcttgaattttaaaggtaagtaagactcggctcttacctcaaacatttcatagttgagtgggggaaccacttgtttaatgtcactgattttttggtctgttttagaaaggtcatgaaactactacctttgagctttttcttattccaactcccttttttcccccccgataatggagaaaacttcttgccctaaagaaacgcaccttaagggatggcatggactattgtggatcttcatatgcttgtgggttttttttttctttaaacttattttgttactggagctgtgtgatcttttctttgaggtcaaattccacaaaaggagctaagattgtataattatgtttcacatctatagggcccctcatgatctataaaatgccttccatatacattatttgatttgcttctagaagggcaaatatttgatccctgtttcacagtggtacacttaggggccactcaagggtatgtgatgagctggacatgaccctgagttctccctgcctgtgacatacctccctttcaataagaggaagaggtgttgctggcagaagctttctggaagaatagaaggtgtattagaaggaaatgtggctatgtgcatccctattggtggggaaatagaaactaattgatgtacctcaccaggacaaatggtttggccaactggggcccagaaacaaagcagggggaagccatagaagtcggtgcctgaatcagctagggctgccataacgaaataccacagactgggtggctcatacaacagacatttattttcccatagttctggaggccaagaaggccaagatcaaggtgccagccaatttgggtcttggtgaggacccacctcctggcttacagacttttgccttctagttgtgtcctcccatggggatggggtggttagggcagaccaagttccatggtgccccttcctatatagggcactaatctcatcatgagagtcctactctcctgaactcatctaaccctaatcacctcccaaaggcacatctccaaataccgtcacactggaggttagggcttcaccatgaattttgtggggataccattcagtacatagcataatggtggagaggttaaaacatgtggaggaagatcgcactccaggatggtcagggcaagtgtgtgggtgtttaattgtgggcataaaaggcacaatcaacaaggttatagaaaacaatgtctcagtggtttgtttggactgcaagtaagaggaaagtgggacttgtgaatgcttggcataactcagctcttctctcaactcttggaaactcacagggtaaccagtccccctgaggaccagggaagctgtgacggatgggagagagtgttgtccccattgccataagcagaatgcagacgtgttatttatttatttttgaggctatacgaatatctgttgttttgaaatatattaggtccaaatttgaccccctgggaaagttttctgtcacttgagaggatactgctttatgtatgaccccactagaaagactaatccttggctgggcgcggtggctcatgcctgtgatcccagcactttgggaggctgaggcggccggatcacaaggtccggagttcaagaccagcctgaccaatatggtgaaactccgtctcttctaaaaatacaaaaaaatttagctgggcctgatggtgagtgcctatagttccagctacttgggaggctgaggcaggagaatcacttgaactgggaagcagaggatgcagtgagccaagatcgtgccactgtgctccagcctgggcgacagagcgagactccatctcacaaagaaagaccaatctttgtactttggcccaggtgcatggtgaagtgtatggtcttgtgttcttttgatatactcacctgattgagcagaatctcacacaagtcttcccttgcttccgaagttacaatgactcagtgacagctataaaagccttcttttcatggtaattataatcagacatctgaatacatttatgcatctatagcttctcagttttacacgtaaatagatgccatcagaagtattttgagggctgatttagctcgaagagggtccatttaaaacctattcttgtgttcccatcattttcggcagccaggcaactgaggtcagtgtgctcataaatggcttcgggtgagtgtgtgaattaaaagctcctctctgtgtgatgataacagggtattttctgctcacaattacagaagcatacattttgaaagtaaatagcctcatagttgttctttcaggtactaaagagccagtttatcaagaattaaggcccactgagttagggggcataaaagcagagtggacagggcagcctcaccaagatggagcttgagccaagcgtggtcctcctggccccttgtgggcagccagcaggctactgactctgtggtgcactaaggagctacctttttggactgcattacttaaacatcagagggtaagtattatgcacaaatctgaggaagattaagggatctgggttgctctgtaccgtgagagatgagattagctttccccagctggcgagactggagacattttaaaaagcattttaaccagagggttttctaagttctcctggaatccattaccatctattagctttgaaacactgactgccaaaaagatagggcagtgacagggcgatttgctctcctttctggtgaggtttgaatcccaaggtgccagatgagactggaagggctctccagacctgccgatagaggtagggagatattacacaaagcctgcttacaaatcgggcagctctacagtctcaaatataaaattcggtcattagcttacactgtcacgtttctagctgaatggcaagaggacttaagaccttctgtttggaaagtcagaaactaatgtttttgcttcaactcttaactcacaatgatgtcgtctcctgttgctgcacagtcctgtggagaaaatcagtcagtattcttgttttcctctggatggaggtgattttagagccattagtgcttctagaagcttccctcccctctgggtccctgaggggattcttttggtacaagtagacagagttgtcaacaggtgatcacggacctctgaaaatagtagtaaaagtagcaatcattattctgtgtgtcaggcactgtgccatgggcttttactctccaccgtatttaacacctcaaaatataataggaaagcccaccaacttggcatccattttggatatattttaaaactaaatttacacccatacatttatattttataattttagtatttttgataataaaatttgtttttttgatcacataaagtaaaaactatttgacatttcatctgtctgtaatgaccacaaatagcattttggtgctcattctttcatatatctctctctctttctgtctctctctacacatgcactggtgtgtggcatgggtataaatagattttcacaaattatattatatattttgtacttattgtacatagcttttaaaagttatgttttgttcctttccttccgttgatactcactccctgctcaccaccatcaaccagtgttgaacagcctagtttgtagatgtccacatttctatccatgtttatgtatatatttatgttttgttttctacaaaaagtcaccctccaaagcggtatttgtcatgtgcccaggatccattattcacaattcaaaatggtggacaagatattccaaaaaatgagattattgaaacatatattctctgtatgttacttttctcactcaacaatacctcatggactgcccttcctgatggtttagggctgactcactctgtaatggccttggaataggatatgaggtgggagaccaaccattttttttttttccatttgagtagtcagttgtgcatgtgccatttatcaataagctgttctctccaccatggatcacaagactcaccttgtcacgtagaagcttctgttgatactggaattgatttctgagttcatcagtcagttctgttgtttgttcctatgccatgttttcattttagtggatttaagtctggtatgatgctcccctcataattctttttcaaaagttttctgccaatttttggatatttgatattacctaaaaatgtattatatccacattaaaaattttgggattctaattaaatgtatatatgaattttgaatttatatgctttattttttcttttcctttttaatgacagtataatgctattgtaagttttttcaatttgcattacagatattttaaaaagccctaaacttttccagccacctgattaaattccttcattgattcgagtactttttatttttagagttggtgttcctaggagtatgaatatattattagcaagaagggaaaattttgtcttctcatttactctgtttatagtaactattttttcccctcaatttgaattataatgataacagcaggtatcccatcttattcctggcatttgattgtttggaatgatgtttgcaattgatttttgatgaatccatattcaagaggtttcttttattcctattttacttgaagttttattagaaatggctgttgaatttcaccaaatgcttttttagaacctattgatgtaaccaaccacttttactccgtgcatttgttgctctcatgaatgatggtaatggatttgctgatgtgaaaactgcctttctggagttgtccttgtttgatcattgacaatattcatttgatatagttttgggttttacttcataatgttttatttagaattttaacgaatatttacaaatgagattgctctgtagttttcttttattgtactgcctttaccagttttggttttaaggccaaaccagtttaatgatatggacttaggtgattttccctatgtttctattgttttgaataatttaaataacatttctttcctttaagttatatagaactctctgtgaaatcaactgtttttgccctctgctttttttttcctcttagaaaatcacttctcctatctctcctgtggtaactggtctattcaattttctacttgagtcagttttgttcctttatattttgtggaaagtcacaccaagaacttcagaatgctcttctctcttccccttctgcctgcagccctgcttcttcctaatgcctatgttttcttttgttcctgagtattactatacccttgaagtttgcctcttatttcagaaatctttaatatttatttacatgttctcagtcatggtatcattatccatttagatttcatagtgtatttgcaagatacccttctcaccactcttttctcctttcccctcccctgtccctggagatctctgctctgatttatttttgttgcattagagtctttcttggtgttttcctcagatgaagcatggggttgatttactattgaaactgcattattccaaagattttctttctaactgtataatcttgagaatgttatttaacttatctgggtctcagtctccttaactgtaaaatgggaattctaagaacagagaccttacaggaactttatgaagatgaaatgagttaatatatgcattctggttatctgttgctacattgtccttcagtagctgtgggacactggttccaggacaccctctgccctcccataccaaaatccacaagtgctcaagtcccttatataaaatggcttattatttgcatataacctttgcagctctcctatatactttaaatcatttctatattataatacctaatacaatgtaaatgctatgcaaacagttgttatactgtattttttatgttttaaaaaatatattctatctgtggttggttcacttcatcggtgtcgaacctgtggatatggagggccagcagtatataatgaactaccttaaaacagcagtgtgacaactatgtattattatctctcataggtctatgagttggctgggtttagctgggcagttcttgcttgggggctgtcatggttggagtcagatagcagcagtggctggagtcatctgaaggttcagctgggctgggagtcccagatggcttttttatttattgtttcagtgttcctccatgaggcctctgtctccatcagagtagcctggatttcttacctgctaactcaaggttcccagaggcagaaaactgctggtcttcataatgtcttggcccagaactggtgtagcagtgcttcaaccacattctatgaggtggaagaatacactctaccttgagttggaggagtggcacaagtagagagggagggaaggaattaatgatagccacatttatagacaaactaccacaataagtgaagtgcttagactagaatctggcactgaatgagtgctgtagaattattaactcagtgatattattgcagttgttaaattaccttcagaatttgcttttactctgagagctgaatgatgtcttgtatgagtatagaagtctaggactgtggttcttttctgtaagtaatgtgcagatgaagtgtgatgccagtctaatgacttttcctttgtaggcaagctgttatttttatctagaagctttcaggatttttcagtaaaagcagaaataagatagttatcaccacttattaacagacctttggaggttctagaaaatataagacaagaaaaggaagaagtagatgttgaaaaaaataaaatatcctctctgtgctgatgattatttttagcaagcccaggaaactccattaagaaaaaaaacaactaactagaattaaagagggaacacggtaagatgagacattacaagataaacatgtaaacacaatagcttttctttttttctattctagcaagtaccatagtttggattgatagaagtcttttataatatattcttaacctggtactggacgagctctttcagttcagttggatgagacttcttatgccaactgaagtcttttaaaaaagcagggatttttttctcttttatttcttcagttactgtctctcttccatatactcctttttctctattatttgcttggctgtgatatgacaattgccttttcatgggaagatttgttcttttgttgtaaagttctgtttttcctattgtagaagattatcctttatgatatgatgggaatagcaaagatggctttgtgtgtgtgtgtgtgtgtgtgtgtgtgtgtgtgtatgtgtatgtgcacactcgttttgttgtttttgtctcctggctgtcctgaaagtgttcccagcagattttcagagggatgctgctttccttactttcctgttactgaggaggctagagtggggaagggatgggggtagcagagaagctttcctggagacctccacaaaggacaggcagctagacctgctccagccctagccctctcatggggttgttgctgttcacagttcccaaacagctcgacctgaattgaactctgagggtgaatagaacaatgagaagcctggaaaccaacataaggggactcagccaccagaaaataataagcagaaggtaagtggtgcaagtcaaacagaatggatagaggagaaggtttaatcctaacaaaaaggtataaaataattccattgcaaaaaatgaagttttctagaatttaaacgagtagtttaaaaatgagacattcaatatatggaaaagatacccaagaaattgctaagagattacctccagagaggaggcaaagggatggctggggaccaaggtgagaagatgacttcctttattcattgacatttgccactatgccaaaatgatatatcatgtatatatgcagttatgtagttgaatggagaatgaagaggaaggtgttaaaaaaaaaatcaagcagtggtgttaggccagggtggaaatttcctgtttatgaattatagtagaatacaacatttaatttggaattaaaaaaaatacatcttttttttattttcttctaatgaaactgcaacagtgttattagtacctgtaactttgtcagcaatagaaatcaaaaatattttcatataatattacagttgttgcagacatcttgaatgtcatttatgttcatcagagcttaaagttataattgttcatagtaccaccactagagcttggtatttaatgtcataataaaagcacatgttattgagtttgtgtattttagtattttgatacttaaataggattggtttccttagtaatcctatggatttcactttatacatttaaacatattatatttggggtagggtctctagctttcattagactgccaaagggatcatgccctcaaaaaggtcaagaaacctatgggatatagggaccattggagtaaactattggcccagaagatcaagtggaagagcaaaaacatataaaaatataaaaataaaagtggaaaaaaaccaaataaaatataaataataaattataaaataaaatatataaattataagtatatggataaataaaaataagtacataatgaaataaataaaatcattagagggacataaagagacttggaggacagtctaacacacccaaaatgggaagaacagaatccttcataataaaaggataaatcttcccaacaaaggatggtggttgggaacattatgtctaataaggcttttgtcctttgttgttgctttatttggatgctcattttaagaaaaacacagcattggcaaagctttgttggaccacacttttgctggtccacaaaaccctccagctgacaacccacagatgcagggtggaaaagcctgtgtgactgtcggaggggagcagctgggtccttcccagcacactgcagctggagagagtgtcctggcagtgggaagtctcagcacaatggcctggtgcttttccacctgtgagaacagctagtgagtgatgcgtgcgctgcgttggcagcagctgcagtagtgtgtccactgtctgagcacttcttgccacttattctaccctcctgggttacccagctcttaccattcttatagggggtaatgaagacatggatttgagaacccttgaattgtttcctgctgatcgataggtcgcacatggctgtttacctagcaaacggaaagcaacatcagttcttgagactggtgactgtatgtgagaaaacgataaaaggatgggggcagggtgtgtgtgtgagtgaatgccgcattggtgtgtttacagttcagtgtctttccggagcatgagagacgaacaagtattgtttaaacgaatgctgtttaaaccctgggattatatagtcatgtgaacttttttggaggaaactgcaaatgttgctagccattgtaattgtgttagttcttgactaaatgtcgtatataaacttcctggtaacaattttaataacgtttgctacttaattataacagcattttacaaaagtgtcagggcatccttaatttatgttttgataagagtgaaagattcagaaagtttgctttcagttatctaaaacttggggccttctccagcatatgcaaacaaatagtaatgcttaaatgcactgtgtgtatgagatgggtttttgtttgtgtaaatctagatggatcctcactccgggggcttaactaaattgggatttacttttctcggtaatatgaagactggtagtgggtagctgaaagcaggtatgaaagctttgggggataccattctcatttcatctttccatacctcgtgctcccccaaatgacaaccatgcctttgggcttcttatctgtatttcaggcagctagaaggctgaaggacaaagaaggaaaagcaaaagtccagtgcaaagctttcttggaaggcctgctagtggcttccacttacatctcattgatcaggaatgcaccatatgtccatcagtatggatccatctagtggcttccacttacgtctcattgatcaggaatgtaccacatgaccatcagtatggttccatccagtggtttccacttacatctcattggtcaggaatgcaccacatgaccacctgtatggaattctgggaagtgtattttgggtcaggccggttgccaccctgaacaaaatttttctattcataatgaagaaggagtgattggatttgggatatgtaagcagaagtgccaggcacaggagccttcaccattcccctctatctttgttccagctgatttctgctcatctggaaggctctgtctgtgccatctcttccaggaagccctctgtgagccccaggtggggttaagtgtccattcttcgagcattgatggtactctgtatccacacatctcatattccctgtctttttccacatacacattttctatatctggtggaaatctctactttaggaatattacctcattatgcttgtaagtgccttgagagtaggatttgtgtccaatgtttattcccagatcttttatttttagtattattttaatttaaaatttttaaatctcaataggtttttggggaacaggtggtgtttggttacatgaataagttcttcagtggtgatttctgagattttggtgcacccaacacccgagtagtgtacactgtacccactgcatagtcttttatcccttgccaccccccaccccttcccccgaatccccaaagttcaatgtatcattcttacgcctttgcatcctcataacttagctccaacatatgagtgagaacatgtgatgtttggttttccacttctgagttacttcacttagaataatagtctctggatacctaattcatgagaggcttaaaacctagatgacgggttgacaggtgcagcaaaccaccatggcacatgtatacctatgtaacaaacctgcacgttctgcacgtgtatcccagaacttaaaaaaaaaaaagaataatagtctccaattccatccaggttgctgcaaatgccattatttcattcctttttatggctgaatagtattccatggtgtgtgtttgcgtgtgtgtgtgtgtgtgtgtgtgtgtattacatttcctttatccacatgttaactgatgggcatttgggctggttccatatttttacaattacaaattgtgctcctgtaaacatgcatgtgcaaatatctttttcatataatgacttattttcctctgggtagatacctagcagtgggattgctggatcaaatggtagatctatttttagttcacttaggaatctccacactgttttccatagtggctgcactagtttacattcccactaacagtgtagacgttttcccttttctccttggcatccatgccaacatctgttatttttgattatggccattcttgcaggagtgagttggtattatattgtggttttgatttgcatttccctgatgactagtgatgctgagcatttttccatatacttgttggctgtttgtgtatcttcttttgagaattgtctattcatgtccttagcccactttttttttatttttttattttattataattatactttaagttttagggtacatgtgcacaacgtgcaggtttgttacatatgtatacatgtgccatgctggtgtgctgcacccattaactcgtcatttagcattaggtatatctcctaatgctatccctcccccctcccccaaccgcacaacagtccccaaagtgtgatgttccccttcctgtgtccatgtgttctcattgttcaattcccacctatgagtgagaacatgcagtgtttggttttttgtccttatgatagtttactgagaatgatgatttccaatttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcagtaaacatatgtgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctttccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaaaattttctcccattttgtaggttgcctgttcactctgatggtagtttctcttgctgtgcagaagctctttagtttaattagatcccatttgtcaattttggcttttgttgccattgcttttggtgttttagacatgaagtccttgcccctgcctatgtcctgaatggtaatgcctaggttttcttctagggtttttatggttttaggtctaacgtttaagtctctaatccatcttgaattaatttttgtataaagtgtaaggaagggatccagtttcagctttctacacatggctaaccagttttcccagcaccatttattaaatagggaatcctttccctattgcttatttttcccaggtttgtcaaagatcacatagttgtagatatgcgccattatttctgaaggctctgttctgttccattgatctatatctctgttttggtaccagtaccatgctgttttggttactgtaggcttgtagtatggtttgaagtcaggtggcgtgatgcctccagctttgttcttttggcttaggattgacttggcgatgcgggctcttttttggttccatatgaactttaaagtagttttttccaattctgtgaagaaaatcattgttagcttgatggggatggcattgaatctataaattaccttgggcagtatggccattttcacgatattgattcttcctacccatgagcatggaatgttcttccatttgtttgtatcctcttttacttcattgagcggtggtttgtagttttacttgaagaggtccttcacatcccttgtaagttggattcctaggtattgtattctctttgaagcagttgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctagatatacaatcatgtcgtctgcaaacagggacaatttgacttcctcttttcgtatttgaataccctttatttccttctcctgcctaatttccctggccagaacttcccacactatgttgaataggagtggtgagagagggcatccctgtcttgtgccagttttcaaagggaatgcttccagtttttgcccattcagtatgatattggctgtgggtttgtcatagataggtcttattattttgagatacatcccatcaatacctaattgattgagagtttttagcatgaagcgttgttgaattttgtcaaaggccttttctgcatctattgagataatcatgtggtttttgtctttggttctgtttatatgctggattacatttattaatttgcgtatattgaaccagccttgcatcccagagatgaagcccacttgatcatggtggataagctttttgatgtgctgttggatttggtttgccagtattttattgaggatttttgcatcaatgttcatcaaggctattggtctaaaattctcttttttggttgtgtctctgccaggctttggtatcaggatgatgctggcctcataaaatgagttagggaggattccctctttttctattgattggaatagtttcagaagcaatggtaccagttcctccttgtacctctggtagaatttggctgtgaatccatctggtcctggaccctttttggttggtaagctattgattattgccacaatttcagagcctgttattggtctattcagggattcaacttcttcctggtttagtcttgggagggtgtatgtgtcaaggaatttatccatttcttctagattttctagtttatttgcatagaggtgtttgtagtatcctgtgatggtagtttgtatttctgtgggattggtggtgatatccgctttatcattttttattggtctatttgattcttctctgttttcttctttattagtcttgctagtggtctatcaattttgttgatcctttcacaaaaccagctcctggattcattaattgtttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatcttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggcctcctttgtctcttttgatctttgttggtttaaagtctgttttatcagagactaggattgcaacccctgccttatttgttttccatttgcttgatagatcttcctccatccttttattttgagcctatgtgtgtctctgcacgtgagatgggtttcctgaatacagcacactgatttgtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcaatggtctttacaatttggcatgattttgcagtggctggtatcagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttgtggttaacccgaccgttctctctggctgcccttaacagtttttccttcatttcagctttggtgaatctgacaattatgtgtcttggagttgctcttctggaggagtatctttgtggcgttctctgtatttcctgaatctgaattttggcctgccttgccagattggggaagttctcctggataatatcctgcagagtgttttccaacttggttccatcctccccatcactttcaggtataccaatcagacgtagatttggtcttttcacatagtcgcatatttcttggaggctttgttcgtttctttttattcttttttctctaaacttcccttctcgcttcatttcattcatttgatcttccatcactgataccctttcttccagttgatcgcgtcggctcctgaagcttctgcattctttgcgtagttctggagccttggctttcggctccatcagctcctttaagcacttctctgtattggttattctagttatacattcgtctaaatttttttcaaacttttcaacttctttgcctttggtttgaatttcctcctgtagctcggagtagtttgatcatctgaagccttcttctctcaacttgtgaaagtcatcctccttccagctttgttgcattgctggtgaggaactgcattcctttggaggaggagaggcactctggtttttagagtttccagtttttctgctctgttttttccccatctttgtggttttatctacttttggtctttgatgatggtgacgtacagatgggtttttggtgtggatgtcctttctgtttgttagttttccttctaacagacaggaccttcagctgcaggtctgttggagtttgctagaggtccactccagaccctgtttgcctgggtatcagcagcggtgtttgcaaaaccgcggattttcgtgatctgcgaatgctgctgtctgatcgttcctctagaagttttgtctcagaggagtacccggccgtgtgagttgtcagtctgcccctacttgggggtgcctcccagttaggctgctcgggggtcaggggtcagggacccacttgaggaggcagtctgcccgttctcagatctccagctgcgtgctgggagaaccactgttctcctcaaagctgtcagacagggacattttcaatatgtttttctttataggttacctgatacttttgcctcacagctcttaagattcgttccttcgtcttgactttaggtaagctgaggactatgtgcttaggcaatgatctttttgcattgaatttcccaggtgttctttgagtttcttctatttgaatatctagatctctagcaaggctggggaggttttccttgattatttcgtcaaatatattttccaaacttttagacttctcttcttccttgggaacgcctattactcttagagttggacatttaacagagtcccaaacttcttggaggattttttcattttttaaaattttttctttgtctttgacagattgggttaatttgaaagccttgtcttcaagctctgaagttctttcttctgctcgtttgatactgttgtgaagacttcccagtgcattttgcttttctctaagtgtgtccttgatttacagaaggtgtgattgttttttatttatgctcttcaatttcactgaagaattttccttttatatcccgtaccatgtttttgatgaatttaagtgggactttgcctttctctgttgcctccttgattagcttaatagtcgactttctgaattctttttctggtaattcagagattttgtcttgttttggattaattgctggtgagctggtatgatcttttgggggtgttaaccttgttttgtcatattaccagaattgtttttctggttctttctcatttgagtagatgatgtcataaggaagatgtgtgattcaagggctgctgttcagattcttttggcccatggggtgctcccttgatgtggtgctctctcctttcccctaggaatgggccttcctgagagctaaactgtagtaaatgttttttctcttcttggtctagccacctagcagagctaccaggctccgggctggtactgtgtagtgtctgcagagtcctgtgatgtatctcatcttcaggtcttgcagccgtggataccagcacctgctctggtggaggtagcaggggagtgatgtggactctgagggtccttggttgtgtttttgtttagagcactgattttgtgttggttagcctccagtcaggaggtggagctttcaagagcgcatcagctgcagtcctatagggaggatgcacacttgccctagggacacctggttaagcattcaggtttctcaggtggtgagcagggccatagaactcccaagagattatggcctttgtctttggttaccagggcaggtagggaaagaccaccaggttggggcagggataggcatgtctgagctcagcatctctttgggtggggcttgttgcagctgttgtgggggttgggagtatggttcccagtccagtggagttatattcccagggggattatggctgcctcttttgagtcacataggttgccagggaagtgggagaaagctggcagtcactggcttcgtcctgcttccacacagctggcagtcctaaaggctggtctcactcctaccgtgagtaggagggctcactaccagggctgagaacttgccccagaccatgagccatcgagaaaagaagcagcagaatcacagtttttcagcatcttagggggcctgcagcagtgattcagttccttctaagggcctgtggattctctcagctttcctggtgtgttcctgtggtagttcttggagcaaaaggtcatgatgtgcatctccacacactgctctgtccctctgagcaggagctgcaagctagtcctgccttctatctgccatcttaatccccagttcccagctcttaactcaacacttggcatatagtaggtgctcagttgaagtttgttgacttgaactgtcaaaaactagtaaaatttactgaaatttaggggtctcagagtacttctaatttttataaaaattccttttttatttttctcttttttgagtataatgcatacgtttgtaagtgcatctgttggatacatttttagttgtttttaatcttgtaaaacatgctggtggtttgtgccagtatacgtgaatatttgtatgtgtttgtgatttgtatctaggtgcagttgttaaatacatgagccatttcctatggcatcaagtacttttgacaagtgtgaaccaagtcggagttagaaatggtggtctcagacataggattctagtgctgtgactaaggtgcagtttacccctcagggatgttggaaaacaaatgaggttgtttacctgaaaagtaactcttgcttctccagtgaaaagtcctatgctaatttctggtacagttaatcctctattccccatgtcaatagaaaaaaaaaagagtgcagattgtctaaagtcgttgattcctgattttgaattgaattataatgtattttggatgctggcaggaaaccagccttctgtgtggataaaacaaggctattgttcatgcgagtcagtattcaataaatctgtattatgagctcttgtctaagccctatcaggggcaggtgatgtgtaatacatttgcattatgaagggcccaggcaagtacaatacatctgaatgtatgggtgtactcaagttccatctgtgttttctatttagatcataggaaagttatgtggcctcattaggtttgtaaatgctttcaccatgttacatttcattgttttactgaaatgcttatgtgaagagtatctccagatcttcagcagaactactgatgaagtcatcgaccattaggattagtacagtggaatggttggtctaaggtccaaagtgtggtgccagatcagcaacatcagcatcatctaggaaactgttagaaatgtagtctcaagctccattccacagacctaatgactcaaatgggagtggggtccagcagtctgttttaacaagccttctgacgcagcgtcaagtttaggaaccactggctaagccgtaaaatcaagatgttttcagtgtcttgcataacatctcagaattcatcatctggtaaaaatgtgtgtgtattttttttttttataaacaggtatgaagtctttctccagacaacaagagtgacatcactcgtcatgtttccatttctgccttttccttcaggaaacttggagctgtgcttattgcttaatcataggcattccatttactccatttgcctgggctttttatttcctcttcctttccatgaattttatttgcttgttttatttaacagcctttctatgaatcttttattataggccttctcaaatccattttgctagttagtgggttggcagtgtggggtgcgatataatttgaaacaaattgactcactcacatgatatgattgacagtggaagtatttgacaaagaaatgatagtaggggaagctagcatggaattaagcatattttgcagaataccatgtatgcccttgaatacttacacatggtaagacaattcaaacagtatagagaaatataaaatgaaaagtttaaaacctccctcactcccttagtgatggctctttccccaaagataatcattaacacagtttagaaaataaaggttagacatagagcccacatatatatgtatatgtatttatgcatttgctttttaaaaatcacaaaaaggacctagtgtacattcttgtttgcatctttttttctcgtaatatagcatatggtcttcttattaaagtctgtacgatattcttttgtatgattgtactttataaacctacctcctattatcaggtatttagattatgtgcattctcgcctatattatcttgacacacttttgaaatttatcagctaggaaaattcttggaaatggaattttgggattaaagagtatatacatttaaaaaatgaataggtactgcctagtaactttccagaaaatataaattaatttgcttttcaaatgagactctcttttcccataggatattatcaaatgaaaacctttttaccaattttatgggtgtagaaatcgaatctaattgttttgattcacatttctttaactctgataaggttgagcatttaaaaaagatttattagctaattttatttcttttttttttttgtggactggtgtttagagatgacacttatctatgtttttcatgatctaatcttcaagttcccatacctggaaatccttagaatccatcagagaagctatttttgttaattttttttaatacagattttctgattctactctagagttctcgagtctgtttctcaactcttaatagcctgcttttacagattctgttgccaatcagtcaggtgtaggctgtggtccaagagcagcataaacatagcatctaagggagctttctcacaccagcagtgtctctgctgtctatatccaattgactagaaatcagttttcaatattgcattgtgagcaatattatcgttggaagccaaagtactgtgtcaactttttttaagcaaaaaaagtatatgtaaaaagtaatatcatattaggatccaaactgccttttgtggcagaaatgaaaatggaatatagagaataattttttctaggagaattcccatttgtgaatgatgtgctagttcagtgttttcctttcataatcattaactcatcatgctctccatactaccttttgagcctagaagcccagagctgaattttaagaccaatcatagcaactgtattttgctaggtttctgatatttatatttttttccgaatttctattgtttttgagaatgttacactcatctccaaaactctcccagggcttgtgttttcccttcttcttgactttataaaggatcaacacatctttaagtaccatctgcagttggccttttcctcacccaagggaaactgaggatatttgggagtcccgaactgggtcctccagacaccctctgttactcagtaattatggcgccaacatccggccaggcagctgttccttgcccaggagagactaagatgggggaaagaggaggttgagtttgtgagttactgggtacattttctaccttctgatttactgcaacatgatacagaaacatggataaataaaccagcccaaattttctcatgtgtaaagaaaagtgaaatgacgagatagagagagagagagattagaaaaaagaagaatttcatctttctactatgttacagacttaccacactacagtttatctggcccgaaattcttttagttgttcatctcccacttattttattctcctttccacctcatttctgtgagatttgcactttccacttattcttgaaatcagttaacagttaatctattccctggcattagcacttcccctggggacttacctattgattggccttttaatctagttgttaaaattctcccaatactcactgacatggagcagtttcaatttgtgtgttttaaagtgttggccagggtcattagaaaagtgaagttcacatatctactttgtggcacaaggacagtacctggcaattgatttgctatgtgactgtgggttttggggaagaagaagggaagaggtatagagaacaattaccaagtctactctaattctggggtccatccgcattctgcaccatacagcgtgatcaataagaacatatcttataacctttacaggttattgaaaatgtgcataagttagggatactggccaaagggtggccacttgcatctttaaaatgtgtaggtggttctttagcaatctcagaatctatggccacttttccctagaactagttggtgttgtgtttgtatatttttacaaatttatgtaattagaaataggacttgataagcaatagaactttgatagatgttcagttaaagaacttgtaccttttttcttccctcagattaatttgtgttttatgccactattcagaaaaagaaatttcagagtattagaataagatataattttaaagtgattttattaaagcatttgttaaaacatttactaaatggtccctaatgtatttttaatactcactgttaatatttcttaaattctcacattctacagttttgtaatgacaaactttctcatccattaaaatctttctttggaaatagcttatggtttaaaggtgtttctaaaaaaatagtatttttaaatttgcgttatatttttgtttgaaagatggtactattctttgaaaaatcaaaacattggcctttagtagagaatatatatattaaaatcgcctcaaataatataaaattatacttttaacatttctgtctttcctattaaattatgattttctggaggataaggatcaactcttatacaaatctgaaccttcataactagcacagggcttggcccgtattgaattctcagaaaatacttcttgaataagacaataaattaattgcctctttggtgaagttaatatattctgtagtaccctggggttatgaaataccccatgaactgaaaggacaaaatccaaaatataatgacttagtttcttaaaatggtgacagtttagcttcttaagaggcattctgtggaggtcatgttgaggctgttggagcatttagaatggtggacaccagctggcaggcaggaaccaaaacagtcatggggtgcgtttgtcctcctgttacgttttgttcattttgaaccagtttacaacattaaaaatgcagtgatcttacaataaaagtacagacttctgaggtttcttaaaaactcagcagagctaacctcactagcccttgtggcaacattcagccagagctggtagtgggtgttccttatagatggacacacactctagattttatcactgtccaatgggaaagagacattctgtgggatgcatgctgtgtagtataaatatatggaaccctacaacttggtgtaggatgtggaggaatctgtgctccacagtcaggcagatccttttgaactggccatgcaaaaacaaatagggaaagcagggccagaatcaactctcgtccttagactggctgccaaacctcagttcctggagagagagcagagggagtagtatagatccccctctgcctggctgaaaaaggaggatggctctttagtgtggagtctgtgaagcacatggcagaaggcagggggcttgctaggggcaaagaagggggctaagcctagagatggtacaggcacattagaaaggactgaagcagatgctgagagcaactgaccgggagaaatatctctaagggaaatggtgctggagctggggaaggcttggagagctatcagactgcaatgcaggtctcacccttaacgaaggagagagagaagggaggaaggaaggaaggaaagaaagaaggaagggctgggtaggccttacactaaactgtaattctttttttcttggagacagggtttcacatcgtcccccaggctggggtgcagtggcatgatcacggctcactgcagcgtcaacctcctgggctcaagtgatcctcccaccccagcctcctgagaagctgggactacaggcgcacaccactgtgccaggctaatttttgtaatttttttttgtattttttgtagagatggggtttctcttcatgttgcccaggctggtcttgaactcctgggctcaagccatctgcccaccttggtctctcaaagtgctaggattataggcaggagtcaccatgcccagcctaacctgtaattctaagaaagtttgacaaagctaacaatcccgagtcaaagttgccacagttgtgccttacagacctctttttctactcaagtttgaagagcagtgcctccgtgacttccatgggctgcttttcctgagagagaactcagaagaggaaggttagcatgacaaactatatgccttcctcaccacagttaatttggggtctgcagtgggtactcatcttctccttcctgagctgcccactctgagttctccatatccctaattatcaccttggtgggtcttgctggcttacttaatgatgtgacccaaatcctctttcctgggggaatgaaacctttgtagtcatgcccttcagaggctgggattgctgcatgtgtctgttcagttatagtggggtaagggagtatcaggaggcacccacatgggttgcctcggtttcatatgtattcctctctgccttacctgggtaaaaacagccctgcctcttcctgccaattagggtcagttatctctgccatttggtccctggacacaaagaatccagggtgccctcgtggcagctataactgtagttcagtgggacccttgctaagttctttggcaagagggtaaggagcccaggacctcccttacaacgcccagagttttgtgaaggagaagcatagaatcccctggtgagttatcaggagtgctaataagcggggctactcctgttcttggttttggggcccatgccatcttcctattggagacagcaccccgtggaggactctgatgcagtgcgtatgctgcatcctgaaggacagcaccacatcctttcagaagatcgcctcctagctggtgcttcacctgcacatttagaaggcagttctagtgttctgtgaggcctgctgcttatgagtggtgcgatatgtgatacaacactggattccatggtcttgggcccaatcttgcatctcttttctgtgacagcatgggaagatgttatgctgtacaggatctcgtgcctatggaccagccagtccacaagcccccaggtagcaatgctggctggggctctgctgggtgtgagtgcctttatgactgggcatgcccaatagaacccagctcatgatgggtagttccagattcaggatcactcattatcacatgggcaacactccattgttagcaggaatcagtaacatgccaagggcaatttcttaaaagggctttactcttctactgcagatgacatggacttgctccagaatcccaaggcctattttatgattctcccactggggctcgccataagctctatactgccttgtatatactgataaagcatttagactttatcctgtgagcagtggggaaccattgacagtttctaactgtggacctatattattagatcttttagaaaactgtaatacagaatgtttggaaagaaaagaaacagtcagaccagcaaaaattaagcgtctgaactaaaatttaggccataggcatgatgaagaaaggggaagtgatttgaagagtatctagaaagtaggatcagtaaaatggggagactgcatgttgggagggaaaaactgtctagaacaattctggggtttgggggtctgcaaagtaaccagaaaggatttcatgtgttaaatttttgatgctgcattttagagtaaagagttcccaaggactataccactaaaagaaacttgacctgtgttgagctatatttaatcagctggatttttaagtgaatcccaatattaattcatattgaattaatttttttcttccaaaaaatactgagctgggataaactagaaatataatgaaccagaatatcaatattgttttcatctgttttgttttctttgtaacaccagaacctagagtagtacctaatacatattagacacagtaaatatttattaaatgaatgaattttcccaactaaatcaataatctgaaatttgtgattcatttttgccatgagcattgagttactactgggagatgttgaacttgcagtgtaataaatattggaggagaaatgctttgttcactcgtcttgtggtaagcaggactgattgtattaaattacagacaattcggatgttttctgattttgcatgggctcgatctctatggcctcatcaaatcttcacagcaggaaggcatcaagagagatcctcttttttctcctgttgattataagccaaagggaacaaagatttccaggcaatatggaaattcctttgtgacacaattgtaggggaagggaaacccccacattcttactggtccaaccagtgcaagctgcgattcgatcatttcctttttttccctcatgtctaggagtttattctaagaaaataatggggcatagaccatataatgtagtagcaaggatgttgctcacgcattatctagaacataaaaatttggaactccctgaaatgagtaataataagaagttgaaatgggggacatggccctttaaaataacctacattttgatctgtattgataagattttatagttaaagcaaactgggttaaagagaaaccaacttctaacatatggaaacacttctttcctctaattctctcgagaccttgcgctatttctcagatacctgtccacaattttcccattgactttaatagcttgaggagaagctagcagattcagagaaggcctagagcatttggccagttggcaaagtgcgagtaccccagagccccaggtttcaatgtttgcttccttctcttcacccttcttcagcacccagctttcacatgcttgctttatacttcttaaaacctaaatgaccactttcccctacagtgacacattcttagcatgtccaggatacattgagcaagccagcctctctcaaaggcagttcttttgttcaccttatcttctaactggctgaagacttttaaaacctggcatatgaaaccaggctgcttcaattcaaattttgagtctgccactttctataatacaattataggtgacaattgatcttccttagcttactcatctgtaaaaactgggattaagataataacctacctcagagggtaattgacggagtcaaatgtaaagcatggaatgattcttttcaaataatatatcattttcagccatcaactacaaaagaaaggtgagggtggagtgtttctttgtagtacttctgcaggtatgatgcctggtctatttcatttccttttgatccccttttactgggctctaatgatcaggcccagaatatctcccatagaagcagctgtgttatattttcttatttaattaacgttgatgtgttggtatttcactgggtaatactcattcttcttcaccctactcctaattggttctgaggtcacagctttaagtgattggattttattcatttatcattaattaagaactctactgtccagtactgtagccactggccacatgtgactatttaacttaaatttcaattaaatacaattaaattcagtgcctcagtcacacatttcagttgtggctagtggctcccaaatcggacagcattgacatagaacatttccgtcattacagaaagtcttattggacagctgacttagacccttccttttgctacccttgttatagagaatcactgtagcatttatcctcactacctgcgtgctctcatgcacagacaagctggcagaaagcttcagatccctataagcataaaaacaggaattagaacaaccagttatctcatatcaaatgctgatccttcaaagacttttgatcaaattcctttgcctcttgtaggataattctctacaatatgtgctcagggtgtgtgtgtgtgtgtgtgtgtctgtgtttctttctgctcataaggaaaaagaccttgcaggatacagtgtaactacagaaattgtatggttttgatattggaactatgttattctacgttacagagtgaaatcagaatgaatgtatcattagctttcctgttgattcctgactacattacttgtatttattcccttttgcctgaatcccaggcctgcctgcttttccgctatgaataacatcagaataagtgactagaaagagaggccagaaagtatgccacctttagagaggggtcatgtaatcaaggcttagttctcacaagcatagttactcacagtccagatgtcagggcgggggtcccagtgagctgaaggcatctcagtgtgccactgcaaacgaggacattgaactgcagggaagttttattgctcaagttcaccctgctctttgtagcagagcaggagtcaaagttcaagtttgcagtctgcaaaagctgttcttttctggttgctccatgctgcctctgaaaatgttggtgtctgtgtgtgtttcatttctcaaaatgtgaccgtcccgctggctacctttagagtaataggtgtgagtgtatgttcgtccctggagaggcctcaagacattttctcttttgttgtcataaaaatcgagtgtgcttggctggaaaggtagagtgtacttcacctggagtatttcaagggtaacaccagacaaccacttccatcaagagggtgaaaaacactttagggaagttactgccaaagaagtgaagagaatcccatcaggtttagggctgagcattgtagaaaccaggaaagatgccatggtagtttcataggtcagggcctgcctacttcctttccccaaagactcggaagacccacaggcaggatagagagaggagacctggtggaatacatcgtactgtgattatgcgggactgctaagagccccttaactgagccgtgtggagaacttctcagtgctgtttgctgcagcctgtggaataacagaatacatttcgggctgtttcttcccgctggcaactttgcagaagcattataaggtttcccaaactgtgttgcaagttagaatcacctggaggattcttaaaatcccagtgtcaaggtcgcatcccatagcagtgaaatggtaatgggtgagagccatcatgaggagtttttcaggatccccaggggattccaatgtgtagcaaatttggaaaccttggccctttttgataccctctttctttaatcccagcacttttctttaatcccaccactttctttaatcccagcactttgggaggccaaggcgggcagatcacttgaagtcaggagtttgagaccagcctggccaacaaccctgtctctattaaaaatacaaaacattagcccggcctggtggcgcatgcctgtaatcccagctatttgggaggctgaggcaagagaattgcttgaacttgggagacagaagttgcagtgagctgagatcataccactgcactccagcctgggtgacagagcaagactccatctcaaaaaaaaaaaaaaaaaaaaaagtgtgtttttatttcttgatgtcccagtttctgtatctgtaaaatggagtaataataattacccctactacactgagtgttgtggggattacagaaagcacctatggaagcaccttgcacctactaggttgagccatatgaagttgctgtttttgtaggtcgaaaatgatgggatagtggcaatctaatactattcagtcctatagtaagtgctcaataaacgttaattgttgctgttattttccatgtaaccaatgtattttatttgaatataatatttatatttggcaatttttatttagttttaaagccatatatggactttaaagcttaatatcagttttctgtctgtattcataagtagtatcataattaacattcattagttaacggaatgggtgaggttctgtctgtgaaaccgttttctccttttataggagaaaacacttttcaaatttgagaaggtctgccccagaccttccctaactaatttgcttcacttctgcctgtgtttttatcctcaccacaagatgctgatcttagcttgggatcagctagaaagtctgacaggtggtgacccaggcttttgacttcttataatagagcttggcatgctatggcgcctcttggaagacctttcaaaggtctttctgaatggaaagcaaacgttcctgggcagtgtcttgacccagatgagtaaccaggtgccttcttcacctactgtgagctgattttaaggactatgttagctagcaagcatgtgctagcattgttcaaagtgtactatctcctttaaacctcctaagagccctttaaactagaggttttaatttccctattttgcaattgaggaaactaaggcacagagaggttaagcaaccttcccaggagcagtcagcgtgctaggctgagctggcccactccagagcctgtgctcctggactgtaccacactgctttcgatgcattacatattctccttcacagtaagcctagcaagtgggtaatggggcctggggtctctctgctctggagcccagcacttcatgtccttgctgtagtggttcctggtcagcctgcttgtggctgttgggtgtggctgccacacccatttgaaatatgtgtacattgtgaaatgattaaatcaggctaattaacttatcaatcacttcacatacttaagattttttagtgatgagagcatttaagaactattctcttagcaagtttcaagtatatgatacactgttattaactctagtcaccatgctgtacaacagatccccagaacttattcctcttatctcactgacattttataccctttgaccaacgtctcccatctatctgtcttcccccatcatctcctgacaagcatcattctactcttcctctgtgagttcaacttttttaggtcctacatatagtgagatcatagaatacaatgtttgtctttctgtgcctggcttatttcacttagcataatgtcctctaggttcatccatgttgctgcaattgaattttaacagctttttctctaagcccttttatttccagtgcccaataatcaaataagtataccccttgtatacttatttgattattggaatgaacatagaggtttatctgatctttataaaatgtaatggatcctgagctgggttggcagttggaggcaacaccaagacagataaccatctgcccccacagggcaaggaggtacagggtgacctcatatgtacctggaggatcagctggactgccctgcccacctcccagcctctgccttcctctttcatcagcactgtgggggcagctgtatctcaggtgggatgtggaggtcaaggaattagattggcctgaagcattcaataaaggaaggttctcttaaagtaagcttctgggttatttgaattttaaaagaaaacatttgtgaaccttaaatacatttccagttcgtgatggtatcaggctgcatgatgaaggggggaaattttgataggtgggatgcagatttggggtagattttaaccaccctgtacattgcaaaatgagacgattgcctactttctctgttgaaattaagcaaggtttagagttgctatgtttctgctgactgtgacatggcacactgggctgaaaagtgtcctagccagggtggcaggaaaacgaggctgcccttgaagctctaattgtttaccagcttttttctgcggatagatacctgaaatactctatgcctcaattccttcatgtataaaataacacactttgaataggacattggttccccaaactactcctcagaaaactagactagttaatagacgttcattaaaaaataagctctctgccggggcggggggtggggggtgtcactgttcaaataagtgtggggaaaatgctgacttaagcaaaaccaaagagatttcttcactgcagcacatttcagagcctttaatatgcttatgtgtattctgactcttaatgcacagtatttcccatggatgcctctgagtaagcttgatttgggagatgtgggacagaaccctttgctggtccaatccagccctgataaaagtattactcaaagacttgaagatttccccgaaagatgccatcgtctcaagatggctttatcttctcaccctcctcaccagaaacaccccaaattcttttcttcttccaagttcctgtagcatgcgtacacatgtcaatatgcacacaacacacacacacatccctctgttataaaagcagttattatgattacttctatatcaaatcaacaaatcgctatcagagacctcctgtgtcataggggttggggacctaaggataaatcagatgatgtccataaaatttacgcccttaaggagctcaaaatttagtaaaaagtatgtcatcttaacagttctactacatgttggcaatcataataactaatgaaagctatatgtggtatattaattcgtatcttgtccctacggcatagaagctatcggtctcattttagagatgaggaaagaaaaagtaacctgtccaaggtcatagacctaataagtggcaaagctgggacttgagcccaaatctgtcaaaatacaaagcccattcattgtccttacgaaataaggcctgtagccaccttagataggtagaggccaaaacaggagcagagaaggtggtttctaattgatctggtgtgaggagaggggatgggaggctttctaaaggaagtgaactgagacttcagtagtgaattgaaggaaaccaaggatgacagcaggagccaaggcactgaatgagaagcagcgtggtgcactagacacctattcatagtggcgctgtcaattgagctggaatgtcaaggggcaagtggtaggcaggcaccagatcatgggaaggcttgtagacttccccttctacccagaaccgatgcttctcattgctgctggagctcccactttacttcctccccaaaggttcgtcttagggttgttttgaagacagaattgggccctagttgccagtctggttggagactggaaagcttcaatgggatcaccttggatcagggagtccagggcattccacagctcgcacctgcccctcaggttgtgtgtcatccctgtctctctccattttttccttccttttttcttccagataagctgccctagttggaaggaaggattatggatgtcttattggttttcatggataatgcctgtgtagggttgatgcagtcatgtcacctggatcctcttcctgcgtctcacatgtgtgtggccttggttctaaggatggcacatcaacatcacaccatgctcactattcactaagtgactgaagccagcatttcttcacatgctcttagcagtctttatggggacttttattttaagaataacattaatgattttactaagagagctcaagaatttgagtattatgctagaactattaacaataatgtatataacagatactgttatctatgcctgccttgtagagcatgatgagtgggtgaatgagtgaacatgtaaaatagaaaacaaggaggacaattttcttatccataggaggctactcagtacttttttctctaagaaagaaattaatttagatgcaaaaacaaaaatgttctattatcaaggacaacgctcttttattaataacccctgtatccttttctacctgagtgaatgctatgtaaaatcttattatattctgctttgctacaataatacacttcttcaattatcattatttatagagacttataaatgaagatggtgcattaaaaggaagaattcctgcctcagtgatacagagttgggagcttatttgatacatttttttgccttcaaatgcaggatgaggaaatccttctttcctctaactaagtgtgctaattagttaaatgtgtttgaaaagtcaaattatagtttaggttgatttagccaatcttataccctttcacaaaaataaaactgcgatggtctttgagctgtcaggatacatactgtgtgtagctgaaggtattaatcacagatttggaggatatgtacacacatagatttgtttttaaaacattcattatcaagtgagaaatattggttaagatttagaagttggctgctaatgaacccagtggtttgcaaatagggttagccatagggtttttacctaagtcattgttttgttgttggctgtttgaattttttttctttttcctacaagaaaagagagcacaggctggctcttctctgctgtgagaaattctggaagaactctccacacctaccagattagtaattacagctctttcttgaacttaaattatttcaaaggccaaatggaaacaactctcacggtttttggacaaatatttggtcaggattcttggaaccatgggaaaaaccctactccatgccaggtaggacacaagattcagtatgagttggttcttcccagtcttgagtgggaatcaagatgaggctaagtgcttgttaatggttgaaggtgagccatattcttcacgttctctaaccctttcttgacagctagctacaagggcagatggtttaggctttgtggtaaggaggagaatttgtgtagaaagaaagggcatgatttgtaaattatggtgggagggagaattctggcttcctcctgtccccagaatccatgggacttggaagagtgagtactctgtactggaaatagctcaaaaggaagtagcagttttttgctgtgagctgggcttctctcaacacaaagcaatggaagaaacatttcatgaagaggttaaagatttcagagtggtttgtttacatttggctttcagacaatgtggtgaggggtgtcaggaagggcagaaaacccttaataatgtgggtaagcagggcagtgccaaagacattgggtggggtgggagaatgaactgatctcaaagcctcaaacagaatcttcatgccagccctctaaaatgatgacagagtggcccaaaacaccttccagtgggcactgccaataaaactcagttcaaatagtgcagaatatctccacgggtgcatagcaggcagcatctgctttataactgattactagtacttcttgtttctgaagatttggaaacatgaataaaagaaaggtaaatgcatcactccaaatacagaaatgactacctctatatagtgccaaggtaactctttttttgattaaaggatataaagcatatgcctcataatctaatgttagatttggaaccaggttattttgaatgtaagaacagacctggctgcaatttagttcacttagaactactatattgtttctgagtacattttacacttccgcatttttggaatatctctagggtaaaaattcctggaaaaaataaaatgaaaaatggcattctgaaacataagaagagtttaatgaaagacactaaaggcaaaaatttcttcagaccaccaccccctcccaataaataaaaaatgacaagctgtaactgaaatgtacctagtgttccattcctgcctgggagttccttgactcctttcccttctggctgtttgcacttgaaaatgccttcttgtcagttctcaagaaccttcagattgatggagaaagcaaacaagcacacagccaacaagctgaatagctcctagagtaaatacatcctttagaattgtgaatacagtcatgcatatgcataatgaccgcataatgacattttggtcaacagtggactgcgtgtccaacagtaatcccatacgattataatggctatactcaatagcctaggtgtatagtaggctataccatctgggcttgtataagtacactctatgatgttcacacaacaccaaaatcacctaacaatgcatttctcagagcgtatcctcgttgttaaatgatgtatgattgtatattactagacatacacaacaagacatcatttgcccttcaggaattgaagtattttgatgcaattgaactttaaatcaaattggggcaagacagcttttccctataactctagccttgccaaggggctccagaaagagaaatgaacttttttaaaaaacattgatttttatgcaaatagattcgcagttaagattgggtatgcatgaataactttctccctctaggtgtagaataaagtatcagtgtctatgaagtccaagagagatcatctctggctagttctctattattgacatttttaaaaccacctttaacctttagctgataaggcttaaagaaatattaatgtaaaaagcatatttatttacaaaacaaaatttaagctagtggctggatccttttggaggactcttttggagccagagttcctggctgcaagggacagaatgccagctcaaactagcttgggcaaagggagatttattggatggatattaaggcttctataataattaaaggaagagttaaaaactggccagaaatgcaagggttgaacacagttggggcttttttgactctctctcatcaccgtttctcttagccagcaagtttcattctcttcttcctcctccatgatgggaggaacatggcatacacatgtttctgcgtgtcacaccttgggggctcctgtaccagagaagactggtttatttttccattctcacttgaaaaatattcaggaagacttctaattggccagacttggtgaaaatgtccaacactgacccaaataacagtagccagtaggcttagccatgtaagaatgtgaaactcttcaatagttacacatgattggtgttagcagaagacccgttcccgtaagaagggggaagtatagagcagaatgcattgcgaatgccccctagaactttggttttattgtttcaaccttgtattttgatttgaaaagttgtaatggagtggtattcaatttttagagaagaaaataggtaacgttcctacttgtcaataggtaacatgtcagtgaggaacactgctgtcttctggtatttgcagaaatattcaccagagcaacctttagcttcattttgcatgcctaggctaatgaggttattcaaactctgtgttgttgttgtagtggtcatctgtggttttgctctcccagcatctagtcagtccttctgcttcagcttgaaacacctaggttttcctgtgggaaaccaatacctcccacattctcataccttgtgatttcaataaaaatgacacttttgctctggtttcagctacatgctagtgacgcagccctgggcaagtggaatggcacattactctggccaattcttggtccaaagatggacctccctcctttcttagagcttttcttgaaacattttgaaaagagacttctggagaatgcctttggaactgctggtggctgtagtttgggaggacctgatgagaataaaagtaaaagagagggcagagcaaagttgagggatgaaaattcctgaaaacaaggttaaaagtccagccatgtctaaactggatggttaggtgagacagtaaaatgcttccccttccttcccagttgcagttttagttacagcctatttgattgggatttctgtaccttacaaccaatgtgttcttaaaaatgctactatcttcatgagctgaactgtaatttctagttagctctttagctccacttccttgtgtttaggtatctgtagctgctttgcaagtcaccacagaccttggtggctggaagccagtaacaatcattttattttctctcatgatttctgtgggtcgggaatgtaagaagggctcagctaggcttttctggaagtttctgtgctgttgcaaggtaactgtggctatggaatagaagggaggagctgggattggagcccctgggggttggctgggcagctctcttttttatgaagtctcagtagctccttgtggactacttgggcttccttatagcatggcagtctcaaggcacttaggctgctaacatggtgtctcagagtttcagcacaattattccagagtaccaggtgtaagttgcatcatgctctatgacctagctttggaaatcacaaagcatcatttataccacactctggtcaactagttagtaaagttggcccagagtcaaaatgacaagatgtagacctcacatctcaatggagacatgtgaaagaattcgcaattgtatttatttatttatttatttgagatgaagtctcactctgtcacccaagctggagtgcgttggcgtgatctcggctcactgcaacctccgcctcccgggttcaagcagttctcctgcctcagcatctggagtagctgggattacaggtgcccgccgccatgcccagctaatttttgtgtttttagtagagatggggttttaccatgttggccagactggtctcaaactcctgacctcagttgatcctcctgcctcagcctcccaaagtgctgggattacaggcgtgagctgctgcacctagcccccagacaagtttttaaagcagggcatatcttgagcaattcccaaattgcatgaaaggtgcctgtggtcagcgtgatatatttaaagagacttagcttttgaaagacctacctttagtttatacttttggaaactgtattaactttttcaggcacctaagataccaccatattaaaaattaaatcaagattgattgtgatctttgaggcttcagaattccattctgctcttgtattaggcatttttaaatttctgtttgaatagcattgaaatatttagatttgtatttgtttgccactttataattgcgtatatactgacttagtcctgagattttgtaatttagtacttggttcttaagatagcttccaaagtgcttaattttcatctagtgaccagtttaagtggaagtatctcattttatagactgtacatgaaatagtaattaggatgtagacttgtaaaacttgacctggcttatggtcctagcactttgcctctgactgatgtagaaatcctcctttatattgtctagtaccatccacacagtgaaggttcagagtgcacctcttctcaactttctcccaagtggaggaagtccaatagatcttgaactaatttttttttttctgttttggaatgtagcaagtaatccattggaataaaaccagcagttgagtaactcatgcaaaggtaatttagagcacaaattaaatctgtcagagcggtattagatttgcaaaagctcataaataacaaatgaaaggtcacagaactgtgaaaatgagagtgtacttcttcataaagagaaccgtattcagggacacgatctgcagtgcatattcaaatagcagcatcataaaatggaaacacaatgtcttttctaaatgtctaatacagtacaaaggcactgcagattctgtggaaaagcatcaaagtcccaggaaagacttcatatcatctgaacatgtccagcgtcacatttgtgaggtttgtggattaaagctccatcaactactgagaatctatgaggaaaagatacatcccctgagcagtgtttgtatttcagtagctgttaggttaattgtgaatgcatgccactcatttttcatttttcagttcctagaaaatactaatagagtgagtggtgcttcatgatttactgcaggaatgtaaacagtcggtgatatgaataaacagtcctgcccatcctgtttttctcatggaaaagagaggtggaaaatacagccttgtctactataaagtagacaagttattttactgtgcattgtatgcattttttttagtcctgtgtcggttgtgatttttataagggaacaaaatctgtttataaaaaataatgtgtgggctctatcaaaattaaaaacttttgtagatcaaaggactccatcaagaaagtaaaagacaacaaagaatgggagaggatatttgcaaacatttatctgaaaaggatctagaatccagaatatagaactcttacaactcaaaaataattagataatattcaggcaaaatattgggcaaaggatttgaatagacatcactccaaagaagatatacaaatggctaataagcacatgaaaagatgttcaacatcactgattgcttgggaaatacaagtcaaaatcagcgtgagatatacttcacagccactaggatggctataatttttttaaaaaagaaaagaaaagtgttggtgaggatgtggggaaattgaaacacatatattgctgatgagaatgtaaaatggtgcagcttcagtgcaaaactggcagttcctccaaaagtaaaacgtaagaccacaagacccagcagttccactcctgcatatatacccaagaaaaacagaatgcatatgtccacacacaaacatgtacatgaatgttagcagcagtattcacaatagccaaaaagtgaaaatcacccaatgtctatcatctgataatggataaacatagtatgttcatacaataaaagaaacctcagatttctgtgccaggtgctttctttctgtttcctgatcagaggtccgtccacactgggttatggccctccattctggctgctgaagcgtaggggagggagggagttccttgtggagtgaagcttgatcagtggtgatcaagcaggaaggaaccaggtagatgacttgtctctttctccttccatgggctacaccaaggtgcaggccttcctcttaatcttctaccgttgtggtgtcatttgaggtggtgagcagcatagtaccctatgagcacgttgcctcctgttttctagatttatttccatctctcttttccccctttccctcattgtcttaggcttgcatcttccaaatagtgttaggacaccaggggagggcatggtaagagatgagaagagagaacattctgtttcatattgaatctattattttagaagacatgactattttgaggttatgttcattggttttaggtgaaaagctgactgacttgtgcataaaaagtaagtctgtcaaactcattctttgaaaaatgttattaaaagtttttctctataaaataatacatgctcattaagatgttttgaatatgtaaatgaatattaaaacactccttaagtcctacattattttggtgtctatcctttcagtccttttactaactacacataaacctagaaaagacatactcttttttttccaaagaagaaatgatttcacaagtaaaatgtattgtgagaattaaaattcaactactttaagaatttggaaattcagcattaaacacatgaaattcatggttaaaaaattatttgaatcccccaaatttgaaaacttgtgctaaagaaatcaggcctaatgaattcagcttgctctttcctgtgatgagtagaggtggatatcttgtaatgaatgaaatagttgcttaatttcatccacgctgatccaccatcctgtgcacacacaggacatggccttggaaggtgatacaaggcaatgtgctcctgacctccatcagcatcttttatacaagtaaaaattctttttctttggtatggagatattgccatacagtcaggaaagctgtgggggacttggtttagttcctggctgcaaagcaggaactttgattgttttctcatgaggcaccctgcttgttatgaggcatagcttcaagcagcaattgtagccatttggggtttttggccatttgggttttttagcttctatgagcagagtgctgtactccagtccctagttttatgctgtgagcctggttttagttccctatctcacatgaagacatgtaagactattctccacagaggccaagttcctgcagccacatccctgctactgggtccatttcccagcagccctatggcattttccccatgttgtatatgtactctgtgtctagtctgtaaaaatatccatctcctttttgacctgagccttggctttttggtattgtcctttaatatatcattagcattagtgtataattttatcagaaaggatgtggaatcatgatatattgtgaagacatctcccaccatttctttttattattattattatactttaaattctgggatacatgggtagaacgtgcagatttgttacataggtatacatgtgccatggtggtttgctgcacctgtcagcccgtcatctatgttaggcaccatggaggtaccatgatcactcttagttctgcacatagacatttgcaaaccaattagacgataaataagtagtatgatggagggaggggggaagcatgtttgacaatttaaacacactattaaaggcaacaaaacaaaaatggaaaatgctgcataaggttacatggaagagtaagttaaaaattgaagtgatgccacatagttttgtaagtcgttacttttttccaaaaagtaaccagaacaaaagttctgctatacttaatcctcatcgatttaaactttgccatgagtttgctttactgtgtactttactatgaatataatttttcatattcttgatattgtgaatttttaactatcccttcaagacatttctcactcccatctgctcatatttttggtcataaaagatatagtatacatgacttcaaattaagtctttttctatagcatggatctggatttttatttttagcagatgtgatgatgtttttatcactcatctcttatggcaaaacaaaggatgagttgacgaagaaagggagtggagggcaagaggccaaccctgaggtattagaatagtctgacataaatgttcccatccactcccacagaggctctcagaaccctctctgtggccagggtctgaggcagggaaagtaaggataatcacggcaagttcctgtcctgaggagctcatggtcctataacctgggaaggagtttacagtactctgtgtcacctcagatcaattatactcttttaaaattatgaaacatcatcatcactgggacatgtcttgtgggaggaaatgttacctaaaaaacaaaacaacaacaacagaaaacatgcagtgggctgaaatgtgtgcccccaaaattcatatgttgaagcctaacccctggtatcttggattgtgactatatttggagattgagcctttaaggaggtaattaaggctgaggccataaagctgagaccctaatccaatctgactgggttcttatgagtagaggaagtgacaccaggactatgcatgtagggcaaagccatcagcaagccaagaagagaggcctcaggagacagcagccttgccgacaccttgatcttggacttcctagcttccagaactgtgagaaatctctgttgtataagccccccagtctatggtattttgttacggcagcctgggctaactcatacaccatggatttactatcttaattttgtattttcctctccagtcttttgtctgtgcatttgttcacatttatgtttacagttacacacataatgttcattccattttgatctctgactctcaaactgagccctgctacgtacagattgggaggagatgggggtattggccatagtgctgccaggtatccatgggatgctgtgcagacctgtcccagaggtgcagcctcaccttaccaacctcaccatgctggcagagaaaagccagatggatgtggaaagaagcactgttgaattcattcaagatgaagtgatgtttgtctctgtcacttggctgctgacttgcaagggaaagatactggtggatacttgttttttcatcatgttgttcaaccaagtgcccagcacagtgcctggcagtcacatttattaagtgattgagtggcccattctcttcctgaatgccaggtttgcttggggaattaaattgtaaacagaagatggcgtagtgagcatgaaattagcaaggttggcattatcaagctgttacaagtgataagagagctctactctgttgtctaacaatttgccaattaaaaaagaataatcacatctggaagtaatttagcatgttatgcattttatggtttcagctatttaaaaaaatattttaaaaagttataatactattcacttaatgtggtcccattctgtaattttgaacaattgcttgcaccctataaacaattgggtctgttgggctccttagagtgttctactttgtaagttcatttttataccttctatcattgtgttttgattaattttgctttgtagtatattctagatctgattgggtcgtattgattttctgtactgagtttctgtttcataatatatttccttgcctatgtatttttacaaagtaattatgctatttaaaaaatcttgttgaacatttatattaaacaaaatatcaaaactgtttgttttcagctaggttaaaataaaatgagtaaccttgactccttgcagagcaatagagataatggtacttggaaaagtagtagaacatgaggaataagctttataggaaaccaagaagatagcaagagaatagcacctatataaaaattaagacagatctctgcattcccagtaagcagagcaattcaggcttattacagatttgtcttttccttaattttgagtgaaaaggacaatcagaataaaggacacagtagatagtaatcacttagtgctatagcgataacacaatcttatcagtttggttttttttttctgagatggagtttcactcttgttgcccaggctggagtgcaatggcacaaagtcagctcactgcaacctctgcctcccaggtttaagcgattctcctgcctcaccctcccgagagtagctgagattacaggtgcctgccaccacacccaactaattttttgtgtttttagtagagacagggtttcactgtattggccaggctggtctcgatctcccaacctcaggcgatccaggccttggcctcccaaagtgctgggattacaggcatgagccactacgcccatccaatccgttttttaaatacaccttaagtcagtcttaagaacaaagaattgcctagtgtttaactgtgcagactccaaagccacattgcctgggttagagtcagatctgctacttatttgctgaaccccagtttacccaaaatgggttaataattatgcctacctcatacggttgctgggagaataaatggatatacataaaggacttcagtagtacctggccaacaaatattagttacattaaggagattttgtgttacggaggcactttttaattttggagaggtcagctttcctgtatttgtttgttttcctaaatctgaaagtctgccctgtacaggtttgcatggacacccgtggcccagtatggctgaactccctatctgacctgcaccattctcagggaaatgcttctgagcttttgctcctgacttctttatcgtactctggcagccatcccctggcctcctagcaaaaaatagctggattttgttaaaattcagtctctcttgataccatctctgctggatatgagaggggatggctaccagtggagccttagcaacctgattaagactagatctgggctggaatgttctcagtgctctaaaattactgttgataaagtttctctccatgtctacccacttccttgtgccctgttgctctccatcccatcttaccagcatgggagctcagccaagcctcctgtggctttctccagtcgatcactgagatgattctttcttcatttttcaggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaagtaagactgttctctttgctgcagaaatatcactttatttcaaataagaagtggttcaaaaactggccaggaaaaggcatccttcagtatagtgaaaacctcccgtgatttaactggggtggtgcggtaatttacaaaagatgttttatgctttaccctcaccttttcacaagaagatttttggtggtgttaaggcaaattattgggcttgttttctctgttccctacacaatcactctgattctgaacactcttccccttgtactcatgccagtcctaagtcagcttttaaagtgaaccaccatatcccagaaggaggattgtttgtaaaagatcaatcctttatacgtaagataatagctggtcttcctctctgtgcatctaattctcaatttcagtgtaatttcctcccacaacttccaatgtcctgtgcctccttttggtttcctatatttaagaattatctagggaatgcttaataacatagatgcccagatccctgccctagagtttctgatttgcatgtatctcaggctgtacctgtgcatttttgcattcagcaagaacttcaagtacttctgctgcagacattctaaggatcacgctttaggaaacacagcagtttgacttcctcttttggtctctatctttgtatttattgtctctttgtatgaatcctcttctgtattgcccctgttgaggtgagagctggttgtattgtgtatattctgaccttcggcttttgccccaaggtgcattactcttttgaaatgctctgtttaacaaatatagtttgagtgtccactgtgtgtcaaggattgtgataggcttgaaagcataaaggcaaatcaaacacagtccttgcttttgaggatcacatagtctacaaagtgaaggcagccatgtggactccttcaatccacgtggttggaatatttaatgtctgcttgttctgggttagctgagaggtggtatgcagaatgccctggggcttggagtccacctgacctagggtcagcaactagctcagctgctttgtggccttttgacttaaaataaattccctatcattgtgaagattaaattaaaaatgtgtatgaagcacttagcactgagtgtgagacataggaaatgctcaatcaatgttaggagaattctttgtgttaattttgtcttttctaaagtggtaaagtaatataatacatactcgttagcattattttatggagcagaaataatatctgtaaaacactaggcctataccacaccaggcaatcaaatggttgtttacattattgtttttattatcgttggcttagtaaactgggggtgctgagaatacaatgctccagtgttgtataactcccatatacttttaataggcagcaaataatttctttagatttctattgtctctgtaccctcttatcagtatagtctggtgcccactggttaatcgtatggaagacttatctggctgcttgttttgtggggattttattttaataatatgcatgaagagaaggtgctttaatatttgttctgttttctagattgcattttgctgttttctccaagcaggcatgctactttattagacttggtgaatcaaaaacctaggtttctgtctcttagggttgattgccagagttttcagcttctgtatgattccttctcaacttcagtgacagactcagtagtaactgggctgcagaaaaggtccacactggacctacacggaggctgtgattgtacacacagagtgggaaggagaattaaggtgactggatttaacaacatacacaccacttctgcctcagtagtgtggtgggtcagtgccctgtgtgttgggtctctattgggaaattcaatttcagaaggaggtcttgaaggctgagccttgcaagcagagggaaatcacttctgctcttgaaaagttgatgaaaaagttctgctcatatgaccaatgttaattaagtaaagccatggcctgattagaagaaactcgccatatgtaaagaattagtagggcttcctcttcccctcactggcctgaggtgatctgtaaaaatggttcactattcatttgacctggaaaaccaaatcatgcaaatcagggttcaaatcttcatgttcactttaagaacacctgtgaaactgcccagaccatcaagcgtatgcatgtacaaaaagccactgagttgtctgaaagatgtcactttacaaaaataatgtctaccattctaacattacagtggtggagttggtagctgtgcccaggccaaacagtgaggctgaacacaggatcagtggcctgaaaagagtgctgatcttttgctgcacatgctttaaaacacagaatcatgctgtacttaggggtttagatgtagattccctggtcactgagcctatccaggtgaacaagtaatccaagatgcacggctgaacttacttaaagagccatacatgagctccccctgtcacatcgaggtgacccttactgaaaagaatcaaattgttcctaaaccagaagagggggttgcagagaagaaaaagatatcccggaagaaactgaagaaacaaaaacgtatgacattggaaataaatgcagcataaaacaaatgcaaataaaagtaaaagaaaaaagaattggtgaggttttctgatatgattttgagatatggagaaggatggaagttgttcctaagtgagattataagtagatgattcaccagcagatcagggtccaagttctctttagagtctccctccataacttatgatgggaatactgtgtaaattgttgttagagtgaagttactatgaatggctcctacttggccagaacttcgtttattctgtccacctttttttttttttttttttttttttgagacagagtctcactctgtcgcccaggctggagtgcagtggtgcgatcttggctcactgcaagctccgcctcctgggttcatgccattctcctgcctcagcctcccgagaagctgggactacaggtgcccaccaccaggcctgactaattttttttttttgtatttttagtagagacgggtttcaccgtgttagccaggatggtctccatctcctgaccttgtgatctgcccgcctcggcctcccaaagtgttgggattacaggcgtgagccaccgcgcctggcctattctgtccacttttaaatcagtattaacttctaatttctttgaactattttagaagtttgtggtgtgtgttttcacactttgattttttaaatggcgtggttctatgtccttgagcactagaccatattaagctgtagtctctacaaataagcaggtatctgttgaacatagaccgtaaaaaatatatgagggaagtatgggattagtttgattttgaattatttgtatagtcacctcactttgtagatgaaggcacaaacagcattcttttgtgaatgagccacatttcattaatgttacaatgtgtaacatgaagctcggaacctgctgaaggagaaatatggtgatgctggagatatgagaagacacacacattttctgtaccagacaaacagaagctattttctcctcattccgatgcccagaacagccatcactgataataactggggagagattggaacaccaggctgggaaaattcagcctctcatgactcatcttttttgctccctggtttcctaatctttgaagtttctgaacatttaaaagaaagaaacttcatggctttcaaacctgaagcactgtcgtcaataatgttcttttctataatccttgtgtcatttgttgttgagtttttctttgcttgtttttatgtgaaaaatgaatttcttcccagcctatgattcaaataccaaatcaaataagaactttcaaaacaagagttactattaagagaaatagagctgcttatttggtagtcagacatagtaagagatagcagagtttaatatactaagtggctgcgacctattcttagcctccatttctttccttagaatagaaagaaacctttcctaagaatatccaattttcctctggttgcatgttttgaatctttccttaatcatgtacaccaaagagctgtattcctgtgggggcttgtttgtgcccatgtagagagccaaataagtttgttcagactatactacgtaagtcttagagagtaaggggactttctaggaaggtaccagataatgtatttatttctgtcagaaatatgtgcatattaaaattatacttaaatattttgttgccaagtggactgagaaaaaagatacatttattagatttctagaatttttatatatgcatccagttttcagaaacaatggaagttaatttggtaaggatagaaaaatgtttggatgcattacacatcagcatacctttcaaaacaaaagtctgttctcaccacggttctggtaactgaaggcctttgtctaggcaaaagttccaagagatggaaacaaagactaaatcttttctgataccgtacaaataaattatggtcggttgaactatggctgaccatgagagttaatggacagattattttacaggaagtaactgggcactttggcgtttctttttttctttacaatcaccttctcttaagggaccaaggacttatgccctgaaatacagagtactgagcttattaactctgtgatcaagagccaaattagattcattcacagctggggccacaacaatttgaaactccgcttgctctacaatgctttgaagtaacaaagaagcaaatagcacatctcttaggaacctctttccgtcctttaaaaaaaaaaaaaaaacctctttatcagatgcagtatcaattagcaagttactggagatagttgttcatctgtagacctcatttctggcaaaatatctcaagagggaagaatttaaccatttacttggtattataccttaattatccactgaaagcagtatgtttgcagagatttgtcattaatcagggtgtgattattcactaattggtatttcctgccaagatgtcagtaaaggttcctacaagcaaatattaaactctagccattgagaatgtgcacagatatggagctgtagattctaaaagaaaactcaccaaaaatgagataatttggttgtcaacgatacgtgctgataaactcagaggtaaaagaatttaagcaaagcttcattttgctgccatagtattttagttcccactcctgtttaaatttcaatatactttgggttcattttcagaatccaggcctcttatgtaagaaataagtgtttatagtatgtcacttgtctcacaaaagatcattttgaaaagtctattaagtaattcaaatttgtgaacactacaacttactagtgttagggtctcaataagtttgttcttggagtagctggatcgtcaatcttcattcagaattcttaatttatctctttgatgggaaagtttccaggaataactaattcagtattccatccaaaaattttactggctgcagtgacagacagataaaattggatgccccagtgaattaatcatgcaaactgaagtggtacgagtagcttgcagccataaaccttggtgaatatgatgatcacttttttgagaaatgctgttctctgacaaatgctttgtatctttttttttccaaaatgtctactttgatcattccacttcaaattttacaagctattttaaagtccaatctttgaaagttgtttatatattaagtattttaaacttgatagggaaactattttttaatgtatccagtcaggacaatttcctaaaatattttatatgattaattaaaatatctgcaagagtattgcatggctttggcgtttgagaacctgttttgtttttgtttttttaattcttcagccatgtacaggaataccttagagattattgcaggatcagttccagaccaccacaacaaagcaattatcacaataaagcaagttatgcaaattttttggtctccttgtgcatataaaagttatgtttgtattataccatagtttattaagtgtggaatagcattatgtctaaaaaacaatgtgcatatctttttttttttttttttttttgaggcagggcttggctctgtggcccaggctggagtgcagtggtgcaatctcagtttactgcagccaccgccacctgggctcaagcgatcctcccacctcagcctcctgagtagctgggaccacaggtgtgcgccaccacgcctggctaatttttgtatttttagtagagacaggatttcttcatgttgctaaggctggtctcgaacttgtgagctctagctatccacctgactcggcctcccaaagtgctgagattacatcgttggccaccatgttccaccaacaatgtacgtatcttaatttaaaaagacttcattgctaaaaatgctaagatcatctgagcctttagtgagttacaatctttttgctggtggagggtcttgccttgatattgatggctgttgaatgatcagggtgatggttgctgaaggctggggtagctgtggcaatttttaaaaataagacaacaatgaagtttaccatatgagctgattctgcccttcacaaaagatttctcagtagcatgtgatgctgtttgacagcattctactcacagcagaacttctttcaaacttggaattaatcttctcaaaaccctgccactgctttatcaacagttctatgatgttctaaatccttttttgtcatttcaacaatgttcacagcatcttcaccaggagtagattccatctcaagaaacggcttttttttttgctcgttcataagaagccaactcctcattcacttaacttctattatgagattacagcagttcagtcaccttttcaggctccgcttctaattctagttctcttgctgtgtccaccacatctgcagttactttctctgttgaaatcaaagtcatctgtgatggttggaatcgtgtatttctaaactgctgttgatgttgacattttgaccacctgtgaatcacaaatgttcttaatggcacctagatgattaatcctttctagaagggtttttaatttactttgctcatattcatcagcggaatcatgatctatggcagctataggcttacaaatatatttcttaaacaataaaacttgaaactcaaaatgacttcttgatccatcaactacaggagggatgttgggttcccaggcatgaaaacgacattaatttccttgtagatctcctacagctcttgagtgaccagctgtattgccaatgagcagtagtattttgaaagaaatattttttttctgagcagtagatcccaaaaggggcttacaatattcagtagacaattctgtaaataaatgtgctgtcatccaggctttgttgttccatttatagagcacagagtagacttaacataatttttaaagtctcaaggattttaagaatgataaattagcattggcttcaatttaaaattcaccagctgtattagcacctaacaaaagaatcagcctgtcctttgaagccaggcattgacttttctctctagctatgaaagtcctagatgtcatcttcttccaatataaagctgttttgtctacactgaaaatctgtttagtgtcatcatcttcagtgatcgtaactagattttctggataacttgctgcaacttcttcattagcactttccattataccttatgattttatgttatggaaatggattttttccttaaaccttgtgaaccattctctgctagctgcagacttttcttctgcagcttcatgtctctcagcctttatagaactaataagagttaggaccttgacttggattaggctttggtttaagggaatgctgtggctggtttgatcttctatccagaccactcaaactttctctgtatcagcaaaaaggctgttctacattcttaacattcgtgtattcattaaagtagcacttttaacttccttcaagaacctttcctttatatttacaacttggctaactggcacaagaggcctagctctcagcctatctcagctttcaacatgccttcctcaccagtcttaatcatttctaggttttgatttaaagtgaaaattgtgttactcttcctttcatcttaacacttagaggcatttgtagggatactagttggcctaatttcagtattgttgtatctcaggaaatatggaggtctggggcagggaaagggagagagagagagatggaagaatagcaggtggatggagcagtcaaaacatacacatttattcagttcaccattttatgtgggtgcagtttgtggtgcccccaaacaattataatagtatttcagagattactgatcacaagtcaccatacagatacaaaagtaatggaaaagtttgacatattgcaagcattcccaaaatgtgacacagacatgaagtgagcacgtgcaattggaaaatgacaccgatagacttgctcaatgcagggttgccacaaaacttcaatttgtaaaaatacaatatctgcaaagtgtgctaaaatgaatggtgatacaacaaggtacacctgcccttaccaaaatagaacctttcaattcaaatgtaacccatttttctataggtgggtaatgtgaaggtataaaaaatatttgtttatagtttacaaaatacttctctttgtcacaattatatgacattttccccctattaaaatttcctcatgaaaatggagtggttggatggctgtgtctaagctgctttccatcattttgtaaaatgatctatgcactttttctatcattctgtttatgaatttgagttactatgtgagagagagcacgcagatgggcccataaaaagttccgattacttgtcttttttagactgtttatgacttttgatcatgacacattatttgatattgtcatagtcaggtctgtgaagtaatgcaagcatgtacatggatgggcagctattctcggcaaggtgaaaatcaaagtgatatctggtccatcattctggccttaagctactgccttctccttcatttatttttgataacatatctaattggttccatgtgggcagagcaatttaccctgagatgattatttccgccagtgggatatgcaggctcagccatctgcgagagagaacagttggctcctgcagatgaagtgtttgagtgtttgcagctttcaaataggccaggtaattttacaaattaaacagcacaagttttgtttatgaaaggcaaaactctaagtagtgaagcaagcaaatgattagagctaagaagcaattaaatgcacatcagtagtaaggacaaagaacagctgggcctgacattcctcggtgatcctcatctttttgtggagagaaggccttgggtgcccgcgacagcctccagagctcaaatctcatgtgacccctcctcacctgagcatataggtgaagaatcaaagcacttggaggacagttccttctgaaggcaggaagaggcaactcaccagtgggagcagtaggaagagataagtggggcttcctggaatggcctagtcctcaggctagaactggtagcctctggtgcctcatccccacatccccccagcatctagcttctatggacatgggtccgaaaggcacctgaagagggtcacctctgcatgggcagcatatattttagcaatgaagactcttctcttagctaaggcttaccatctccaggggttcataatgacatcaggtctgaacagataaaaattttacaatgtaccagagaaattgccacttttgtagattgaaatggtcaaacatcaggaaattttatgatgattcaacccaatatttttatttgcatgttgacatttgtgtataagttgacatgagtaagttattagaaatccagagaatgcctttttaattaaaatttttattgagataattttaaagtcatatgcaattttaggacatagtacatgatgctgagtgtggtagttcatgcctataatcccagcagtttgggaggccgaggctggaaaatcccttgaggccaggagtttgagaaataatacagtgagatcccatgtacccattatccagtttgtcccagtggtgacattttgaaaaactatagcataggccgggtgtggtggctcatacctgtaatcccagcactttgggaggccaaggtgggtggatcacctgaggtcaggagttcaagaccagcctggccaacatggtaaaactccatctctactaaaaatacaaaattagccgggtatagtggcacatgcctgtaatcccagctacttgggaggctgaggcaggagaatcacttgaacccaggagatggaggttgccatgagctgagattgtgccactgcactccagtctgggcaacgagagtgaaactcagaaaaaaagaaaagaaagaaagaaaagaaaaactatagcataataccacaactagtatattaatatcaatacaatcggtctaccaatgtcattctgatttccctaattttactctgtgtgtgtacatttagttctacctaattttatcatgtgtaggtttgtgtatcctccaccagagttgagacactgaagaatttcagtaacacaagggttcctcctactggcctcaaacccacctctctccccacctctccacccctacccccacctctgccatccctaacccctgacaaccactaatcatttcaaaaatgtcatataaatggaaccatgcaatatataacgttttgggatgggctttattcactccaaataatttcctggaaactcacccaagttgttgaaagtagtaatagttcattcctttttattgctgactaatgttccatagtatggatgtccaacagtttgtttaaccattcacccactgaaggacatcgaggatatttccagtttttgggctattacaaataaagttgctgttgacatttgtgtacagatttttgcatgtatacaaatgttcatttctcagggacagatgcccaagagtaaagttgctgggtcatatggtagttgaaggtttaagaaactgctaagttgtcttgagaatcctttctttaaaataatgaaaatgtcttaacttcacaggattctgtgccttgtctaaaaattaatcttttctcttaatccttttttttagccacaccatatcctggtggatttaaatgtttcacctgtgaaaaggcagcagacaattatgagtgcaaccgatgggctccagacatctactgccctcgaggtaaactctcagtagactgattggggtcccctgggctgtccgtgagtgaacagcccttttgactttggtgatgtataaagagaggcatgcttgcaatctcagctgctcctcttgtctaaggctattagatcttttgtaccacaccaataacttatcagagattctcagagacataaactgagccataggattgtttcctttctcatgaagtatttttggcactccacaggaggtgataccttcgcctgtacccccgggcccagtcaaatgtaggaaaagagaacagccagtctgtctgccactctgaggcattagtcagtgcatagtaacctcttttatgtaatgtatgaattgatgttcatataaagattccattgattacatatcttgccagagactttcatgcagtctctagaatttagaattctgaatgtcatcattgcacaaataaaatccctgagatttttaaactattaagttttttttgaaggatgagatgaacactgaactgaagcatggaattttgaccgaaaggcccatttcaaaataaatacccattatattcatgtctcttttatcctatcaaaaagaaatagatggttatatttggctacagagtcactgttaactggctattttactttggaggaaagtctatttatttggtgggggtagagataatgagcacagggaattttattgacaaatgttcgagtgaatagttagatgggtttcactgctgatctaattcagttgttaaaatggcttggacacaaccacaccaaatccattatttttcagtataacacgagtattatataagagttctcatacttaacccagtgaatggtattctgcctcttgtggaggattggaaattgggagagcatggaaaccaaaattaaaggaaacatgtcaactatccaagctagtactctaacccaggagcctccactccacctagtgtgtccagtagaaacacctgtggaatttttcaaagaaatcactgaaagccttgccctgtctagaccagtggttttcaagcttcagcagcagcatcattctccagagggcttattaaaacatagatttctgctcccacccacttcttcacccacatttctgattcagtgggtctgagatagggcctgagaatttgcatttctaaagggttgtcaggtgatgagttaagaatcacagctctacacaaattgagccagcatttctgagattagggccctgcattggtactttaaatattgcagatgattctaatgaaaagtcaggggtaagaaccacagggagctcctctacataagaaacagaaatgtagtgttgtcatttctaggctcttcttgttgacttttaggtagagatgataatagggcctacagggcagagaaaaacatggaagcactaaagattggcttaactgaaaactagatatccagccgtctgagtaatcgaaaataagttttattgccgtctgtagtcactgctcatttccaaatgggccagtattttctaacattaccactgtggaatgaacattgctaatggatctgattaaaccactgcttctcagacttggctgtctattgaaattacctggtaaactttcgaaaacactaacacctagatttgttcccagcgattcatattaaatggtccagctaggcataaggatttttaaaagccctccagatggttctaatatgcaaccaaatttaagaaccatcatgaacagtgacttcaggcaaaaccaagatgatttgctttgtatatctagtcatctttgggctagttcctgtggtgataaagctggctgatttgcttttgaagctgttgccctgttggtcagagctagtatataggaagcgtgttttagtccacttgtgatgctgtcataaaatacctcacactgggtaatatataaacaatagaagttatttctcgcagttcttgaggctgggaagtcccagatcaaggtgccggcaggttctagaagggcatagactctctgctttcaaggtgacaccttgctgctgcatcctctggaggggaggaacactgtggcctcacgtggcagaagacaaaaggcggggaagggaacagacccactccctcaaacccttttataagggtcctaatcccattcttgagggctccagactcatgacttaatcaccccttaaatgccccacctcttaatatcctcacattggtgattaagttgcatatgaactctgggggacacattcggaccatagcaaaatgtgactgcttctcctggtactgactgagctttgaggtaaccttagtggagataatgcagaggaaaaaggaatgtgaactggtattctgtgtaggctctgggccacgtttgatggtatacaagtatatccctgtcaaaaagaaaaagcaagggaccagaaacactgcttgaatgcctcacagagaaaagaggaagttccatcttgatactttcttttgaggtcataatctatcatttcaaagtccagatacctaaaggtattgcagagtggtctctacacaatttatccttttctcttttttcccctctacttttatctttctgtccttcaatttaaagggataaatagaaagtcatgcactgaggttcagaacacaaaacaaccatgctaggccccttggggaattacaaagtgaaagataggaatctggtttcttctttcagggagcaggcggtttagttgggctgataggatctgaacatatcagatgtcaaaattagcaggacaaaggtaagtgccaagtggaacctggcattaagcactgtgggagtttacaggaagaagagctactggggactgaggtagccagcaaaagcatcacgtgctgagaagattgcagtagctctacaacttggaactggaggtccagcattgaagagaacatgtcttccaggaactcactcagagcaaaggcatagagacaagactccccaggtgtgctcagtggatggggagagagctgacctgggagtagcaactagtttgtatgagagaattagggacccaaaatagtggagccaggtgatttttgtggggccttgagcatcaggtaaggagtgggaacttaaagctgtaagctgagaaggggtgaggccacactcagcttcctgcttggccagccctatttcccacgagtcttctgctctttcctccaggttttcttcagatttttctaacaatgaaaataatgccattttattaataaattaaaatagaaaatgtatttcactagtagctaactctagatttttctgttagtagtctgaagcagctctaggactaccaatgggcttaggaagggcaactgagacactgctatggaaattctaagacattcctgggtttttttggtttgctttgtgacatagttaactgggtttaaattatcacctgatgtgaaaataatttgttgaaagtgaaaaaaatcacctcatctaagtattcaatcttataaacgcagaataagtgcacaccccaaattgcttaggggattcactgaatgtcaagaattttctaaagctaacctcagtcacatgcatgtgcatagagacatagtgtatcttagcgactgacattcagggattcagacttgttttgagttattgtttggccaagtaagtgtcaggaaagctttctcctgactggaatcactcttttggcagtggcggcatcagctggacacacctctagctaactcaggttccctgtctctcttcttttcagaaggtgtgtgatataagggcgttctcctccattacattatttgtgcctctggtgcttccagattcatagtactatactcccttcctagaaatgggagcttaagatgctctccataactgactctggttgctttacttgcttggcttccatttcatctttgatctctgagcacttcctttgcaacaactttaatttcatcagctactcattataaatctgttcaattttcttgattttgtgaaccagaatggaaaaggatcttgaaatcacattacgttaggagccaattgaaggaactgatgatctaaaacaagagttgaatgtcgtgtgcttggatctacgtttgcccatgacttttctctgtgctgcaagatgaaaagatcctagagagagggactgtaaaaatggttattaaaagtctatggaattaaatgtgaagtcaaagacattccagtttttaaaaaggcttgttttgtggaggatagctaagccaaagacattatgttcctccttaattatgaagtacagatgcctccctctaaggcaaaatctccatttgaaaatactgctgatatataatcagaaaaagaaaattattgagttagaggacacatattcttttggctccagcttctatgctcttcactgtttttctgtaaaagtaaagaaaaagctggacatatcccttgatggctttttccagattggttgcctgatggttcttgctacaagcaggaaatgtaaatgtgatcctcagctcaactgaagacaagaccatagttacaaattttcaggaacgatttctttattgttgacttttttcagacatagcccaggctgaaacagacaacctttgtgtttgacttaacctaagggtggaattttcttccttttaggcaattttacagttagaatatagccctccaattttttttcatttatacaggagtctctgttgtctctctgaatcccatggggacccaacgccttgcaatttattatggcttatcttttaacattgttctttccctaggatagagaaatcaataccttatccagtgttggcccttgacactttcctttctggagaattcatttgtaatttacaaaaagtgctggttacattttatccaacacttctggctgctatgtaataagatgtttttcagatgatctctcatcatattattgtcatattgctaagtgaaagtcttagacatcctcctttttaaaagtaattttaaagttgaatatacataccgcaaagtgaagagatcataagtgcacaatttgtgaatgtttacaaagtgaacatgctgtgtttccacccatatgaagcaatagaaccccagaggctgctagggtgccccagtcattatactccatccccaaaggtaacaatgttgagactgttatcattgagcatcacatatgtggagttgtatagaatgtactccttgctttcaaacattatgtatgtggcattcctccatgtcttttcgagcaacaaagtcatgttttctcagggatgtatagtagatcattatatgaatataccaaaattcatctattccactattgaaggacatttgggttgtttccagtttcttaatactatgaacattcttctgtatgtcttgtggtacgtgttcatatgcgtttctgctaggtctttctcagaagtgggattgctaggcatggggcatgtaagcattggctttactagatactgcctgaccgtttgcaaaatgatggtaccacttacaatctcaccagcagtgcatggaagtgctagttgctgcacaatcttgccaacacctagtattgacagaaacaatagaaggtagaagttaaccagatgacatttttaaagtgctgaaagtaaataactggcatcctggaattctatgtggagaccatcagtctcgcttctctgaacctcatttctcctgcggctgccctgctagctctgatctcctgtttgtgctcccagtccccttgagaccgatgaaggtgctgccctacttctctgccccttagcagagctttctgcttggtttctcagcctctccacctgtgcaatttttgaatcagcaaatgcctcgaggggagaacaggtatagaatgtcaggcaccactcagggggcttgtcttttctctggtaccttgctctttaaatccagtctacaatggcaggcctgtgctttcacacagatttttgttgtttacattttaattggctattttaattttattctgtttcttggtaagccatcccatttcagctggcattataattctcggaattagtcttagaacttttctagcaagtttttttttttttttttttgagacagagtcttgctgtattgcccaggctagagtgcagtggcacgatctcagctcactgcaagctccgcctcctgggttcacgccattcttctgcctcagcctcccgagtagctgggactacaggcgcccaccaccacacccaactaattttgtgtatttttagtagagacagtatttcaccatgttagccaggatggtctcaatctcctgacctcgtgatccacccacctcggccttccaaagtgctgggattataggtgtgagccaccacgcctggcctccagcaagtttttaaccttaagtcctatcagcccatacaagactttttttcgtacactgagagcatctaaccttctccaattcacaatattttgtccaaatatgttttacaaatccagttgcctcagctgggatgcttccatttgatggtctgccttatcacttttatcctgaccactgttcaccataaagtcctgtctatcctcactacctttgcataccttcccagctgcctttttggaattggccttggtaataagtacattgccttctgaatttcagtgattagttttaaaagaagttcctccagtgagaggttcattaagaaatgtggatgaatattttttagaagaaaatagggaagtctccatttggcagcttcctcaaaaggtgctgacttcagggtagaggagactaaccagttgtgattcagtcagtttgatgagcatttatttgtttttaatttctgccttgaggaattttttacttggaacaagaggagaaaacacatctttttaaaagatctatggagaataattgttaagagcagaaaagccaaaacaataatctggtgcctgaaagcggagactgtagtaattactaattagggtaagtttaaaataattcagtttatctgcaactcaatttgtagttcatccttttcttgagtctattttctttcatcttgggctctttttttctttcgctttcaattttactgaactttgaagtataatgtacataccaaatagtaaatagcatgatggactttcacaaattgaatactccatgtaagcagcaccctgattaagaaatgaccagcatcttagaagctcctcgcatgcctgttttcagtcacttttcctaccaccaagggtcgctgttatagactgacttgtgtcctccccatttttccccctacctgctctcaaattcttatgttgaagtcttaacctttagtacctcagaatgagaccatatttggaaatagtttttagagaggtaattaagtgaggtcattcaggtgggccctgatccagtctgacaagcatccttataagaagagattggaacacagacaggaactgagggaagctgttgtgaagacacaaggaaaagactgcccaaaaagagaggcctcagaagaaaccagccttggccaacaccttgattttcaatttctagcctccaggactgtgagaaaacctttgtttaagcattcattcggtggttttttatggcaaccctggaaactaatatagttaccctcctaatttccagtagtgtaggttaattttgtcttactgggttctttgtagaagtggaatcatgcagtataactcttttgtatctgacttctttcactcaatattatgtgagattcatccatttcgttagatttagttgtaatccgttcattctcattgttatgggaacagatactataatttattcattctgtcgctaattgacatttttacagcgtgtttgtacaaatagttcttctatgcacgttctaggacttatcattcttgttggatgtatattgaggaatagaattttagcttcatagaatatgcataggtttacttttagtagtcctggcaaataattttgagaagtcatgatagtatatgaaaattgcactactggtagaagtgtagtattatttctcttttaaatttgatgagactattcaaattcaatggaagatatgttatagacgtcgtagaactaaattaaaatgttttaatttggttcaactttgaatggaagagcttagctagatatattcttcctacccatccatctctgctggtaatacaagagtttattagagattaaatgcctgctattgtgtgcaatgccctgtgttatatgttggagggaatgcagacaccaacaagaatgggcctgattctcaagattataatgtataatacaacagtagatctcaaccaggagcaattccctcttccctgcccgaagtatatttgtcaatgactggagacattcttagttgttactattggcagtgacattggcatctagtgagaagaggctgttggatgctttaaatgtcctacaattcacagagcagtctgcccaaaacaaaattatctagcccaaaatgtcagaagctgaaaactcccatttctggaaagatggaatggatgtacttttctattcctcctgctaagtatgacaaaaaattctgaacattatttattaaaaagcaaaccaaagacatgaagggactctgaaaggtgtaaagaaaatgacagactagggacttcaagactcaaggaacaacacagtgctgagttcactaggttttctttcagtctcatatattctagacttgaagctaaagaagtcaacatcctgcaaatgccataggcactggcaaaataaccccccaacagaagtttgctctctagcagaaggaccaggaagggggaagcctagaaagataacttttagacaatagctgctctactgcagcaaaacactatggaaaaaattgtagccccaatcccataccagcagaggctgaatggaaagccttgacttcatcctcaataggctgtaatgagatgtcccaacctttctgcttgggattgtgtcagagaaggacaagtaaaggtgacacttgtccctccccaccaggcagtaacaaggtctcttccacagtgtcaatggagaccgtgttagggagcctagactttcacctccaccagcaacaatgagatgcctctactttcccctgaccaaggttgtgtcaaaggaggcttaatggagagtcaagacttcacccttcaccgccacccattggtattgaggctacaacacatctcccatcccatggcattagtagaggctacatgggaagcattaatgaggcactcttaccactctcaaacagggagtataagatcaagagtgtcctaacataataacaatatgtccaggcttcaataaaaaaaaccacttgtcataccaggaagatctcaaactgaatgaaaaatagcaatcaatagacaccaacaccaagataaatacagatgttagaattatctggcagggattttaaagcagccataataaaaatgtttcagtaagtaataacaaacacacttgaaacaaatttttaaaatctcatcaaagatatagaaaatataaaggagaaccaaatggaaattgtacaattgtaacataatgtacctgaaataaaaatctcaatagatgggctcaacagcagaatggaaggaacaaagggaagaattagtgatgaatttggaaaacagagcaataaaaattatccaatctgaacaacaggtagaaaataggctgaggggaaagaaacctctacagagcctcagagatctatggagctgtaacaaatgttttaacactacatcatcagagtttcaagagaacaagagaaagagggtgaagctgaaaaaagtactcaaagaattagcagctaaaagtttttctaagaagctgagcaaaccccaaagaggacaaaactaaagcaatccacacaaaaacacataataataaaacttctaaaaacaaaacgtcttgaaatagcaagagaaaaagaacatctgatatgagaaacattagttgaatgaaacgttttcatcagaaactatggaggccagaagtcaatggtacaatattttccaactgttaaaaaaagctatcaatgctgaatcttatattcagagaaaatatccttcaggaatgtgaagaaattaagacattttcaggggaaggaaaactgagagaatttgtcactagcagacctaccttaaaagaatggctgaaggaagctctatatgcagaaaggaaatgataaaagaaggaaacttgaaacatcagaaaggaagaaaaaacttagtaaacgtacttgatactacaatgcagtacaacagaatgtccttcttctcttgagttttctgaattatgtttgacagttgaagcaaaacttataatgctgtctgatgtggttctaaatatattgtagaggattatttaatacaattatattacggccaggcacagtggcttatgccagtaatcccagcactttgggagaccaaggcaggtggatcacctgaggtcaggagttcaagaccagcctgatcaggttgatgaaaccccatctctactaaaaatacaaaaattagccaggcttggtggcaggcacctgtagtcccagctactcgggaggctgaggcaggagaatcgcttgaatctgggaggcggaggttacagtgagccaagatcacaccactgcactctagcctgggtgacagagtaagactttgtctcaaaaaaaaaaaaaaaattattacaaacaagtgaaggtattagggcataaaaagaggtaagttttgtacacttcactttaattggtaaaattatgatgccagcaggatgtgataagttttgcatataatttaatacctagcgcaacaattttaaaaagagatatactcaaaagcactgtagataaatcacaatggaattctaaaaaacattgatgtaacccataggaatgtaagaaaaaacaaaaacaagacagaaaataacaaaatttgtcttaccatatcaataactaccttaaatgtaaatggcataaatatacaaaataaatgaaatgtattgacagaatatgttaaaccatgacccaaatatatgtcatctgtaataaatttacttcaaaataattatataagcaaattaaaagaatggaaaaagatagtagggaaacattaatcaaaagacttcagtgcagataaaattaccagaggcagagaggaacattatagcatgattaaaaagaagcccatccactaagaagatatagcaatcttaagtatataagcatcacataacagagctgaaaaatatgtgcaacagaataatataaaggaaaggaggaatagataaatctacaattatagttggagacttcaacaccactctttcaaaaactgatagaactacagaaagaaaatcagcaaagatatagaagaattcaacagcaccattaaccaacagaatctaattgacatttacagaacactccatccagcaacaccagaatatacatggttttcaagtgaccatggaacacataccaaaataaactatatcctgagccataaagcaaacctcaacaaacttttaaaaattgaaatcatacagagtgttttctgacacaatagaattaaactagagatcaatgacagaaagataaaaggaaggtcaccaaacacttggaaactaaacagtgcacatctaaataatccacagatcaaagataaagtcttaagggaaatttaaaagacaatgaactgaatgaaattaaaacatatgaaaatttgtaggacacagcaaaaacaatgctgaggccgaaatttatagcactatatgcacatatttaaaaacaggaaaatcaattctctaagctcacacatcaagaagatgaaaaaggaagagaaaaacaaaccaaaagtcaaacaaagcaagactaagcaaaaatcaggaaataataatgataagaataaaactcaatgagaatacatatactaaaacatttcattgtacaccataaacatatacaatttttttcaattaaaatcaatggagaaaaacattaaggtactaagaaaaggaaaataagggaatagtatgaacaactcaaaaacataagtttgacaagttagatgaaatggaccataactcaaaaaacaaagtaccacaattcactaaaaatgagataaatagtcctataactcctaagaattttttttataacttaaaaacactcataaaagaactcttcaggcccaaataatttcactggagaattttaccaagttttaatagaggaattaacaccaattctagataaaatcttccagaaaatggaagagaagggggaatactcaattcattttatcaagctggagttaccctgataccaaaaccagaccaacacagcaccaaacaaacaaacaaacaaatacaaaattccaatctattatttttttatgaatatagacactaaagttcttaacaaaatattggcaaatagaatgtagcaatatatgaaaagaattatgcaccatgacaaagtggggcttagtccatggatacaaggctggtttaatctctgaaaatcaaccaatataatccacagtgttaataggctaaagatgaaaaatcacatgttcatatcaaccaatgtaaaacaattgtcaaaattaaacaccatttatgattaaaacctctcagaaaaataggaatagcgagaaacttcttcaacttgataacatcgattaaaaacctaccactaacattatgcttaatggtaaaagactgcatgcattcctgctaagacagagaactaggcaattatgtctgctttcactacttttatttagtgcaaccctgtagattctagcatgtgcaataagacaagaaaagtaaataaaagacatacagattggaaaggaaaatatgactgtcctttttcacagacaacatgatttctatgtagaaaattccaacaaatctaaagagaattcctggaactaataaatgagttcagcaaggtcataggatatacgataaattgagaactcaattgtgtttatgctatcaattaacatgtggacactgaaatttaaaatatcccatttatatataccatttaaaaatataccatttaaaatatagcattatattgctcagaagaattaaatacttccaggtaaatctaagcaaaacatgtataggacttgtaagctgaaaattatgaaacgtcaatgaaaaaaataaaatttaaataaatggaaagaccgtgttcatagattgaaagacaacatagtaaaatgtcagttctctacagattgttatataggtttaacacaattcctgtcaaaatcccaggaagatttttttttttttagatatagacaaaagtgttctacagtttatatggaaagataagaaactggtatagctaaaacgattttgaaaaagaagactaaagtagaaggaatcaaactaccctatttcaggatttaatatacagctgtagtaatcaagactgcggtactgacagagaaatagacatagatcaattaaacagaataaatagaccttaaaaatatgcccatctaatttttaacaaaggtgtaaaagcaattcagtggaggaaagacagcctttttaacaaatggtactggaggaactggacattcacaggcaaaaaatgaatctcagcctaagtctcacactttttacaaaagttaaagtgaatcacagacttaaatgtgaaatgtaaaaacatacagcatttaggaaaaaatagaagaaaatcttcataaatctagggctaggtgaggttcttagacttaataccaaaagcatgactcataaaagaaaaaataataaattagacttcatcaaaatttaaaacttttttacccggcacaagaccctgttaagagaatgcaaatgcaagctatgaaatgggaaaaatatttgcaaatcacatatctgacaaagaactgctatctagaatatataaataattttcagaacacaccagtaaacaaaatacatcattagaaaataggaaaaatatgaatagacatttcaccaaagaagataaccagatggcaaataaacacatgaaaacatttaacatcattagccataagggaaatgcaaatttcaaacatgagatattatgatacttctatcagaatacctaaaataaagaataagaaaaatgccacatgctagtaaaaaggaggagaaactagatcactcaatacgttgttggtaggaatataaaatgttacagccactctggaaagcagcttgacagtttcttaaacaactaaacatgcaactaccacataacccagcagtttcacttctggtcactcatacagagaagtaaaaagttatattcacacagcaacctctacacaaatgttcatggtagctttattaataatatctctaaactggaaacaaacctggatgtcctttcaatggctgaatggttaaaccaactttagtacatctatgccgtggaatactactcagcaataaaagttaacaaactcttaaaaattaacaaacccagtgaatgagactgagtgaaaatgcccagttccaaaatactacatgttgtgtgactcatttatataacattctcaaaatgacaaaattatagaaatgcagtaccatttagtggttgccaagggttagggaaggggtgggggcaggagggaagaggatgtgactataaaaggtcaacatgagggatccttatggctgtggagaagttctgtatcttgattgggttaatgtcaatatcacagttgtgatattataccatagttttgcagttgttaccatttggggaaactaggtaaaaggtgtagaggatctcctattattaatattccttacaaatgcatgggaatctacagttatctcaaaataataggttaaattaaaaaaaaaaaaaacagtttaaacacaaaaaaatcaattgttttgatcaggaaccatgatctagaagaaaagccagatatcccaaatgagaaagttaagaaggactaagacaacatggagaagagagaagattagcattgacctggttgggaggaagatcaggaagatttcacagaatttatcacatttggattgagccttgaagaatatcaggtgtccaggagtagaagataggaaaaaatatgcagaccatgctaaggatgcacatttttcatcgtgcatggtcaaaagttgtggtactatgtctcaaggtatatacgaggcaatgaggagacagtttggagcctccatcaaggagaaccgtgagtaatgagggctgagtttcagatgccaagctctgagttagaaattaaattaactgatgattctatcagggaagcgcagttactccaatgcacttgacacacagcttcgggagcagagagagcaatggcctattcccaagccactcaggcaggccaaataagcctagtaattcagcagtcaggattccttgacaattaggtggcattcatgcttttgtgcgtggcgggttgcatgtcagagacaaaacaagaaacaatgaggtccggaattgaggaaatggaaaatggaatagaaaagaccagatggataatggagacatttcagaagacttggagactcccagattagggagaaaagtctgagctgattccagatttctagttcaagttactggagaagctggaggtacaatatcccaggaggtcccttcctgagatagacacatgtgaagataaaaagatgcaagggggagggagataatgcgttgggttgagacacattaggtgtgaggtaatgctggaagtgtccagaaaatagttggtaatttggttctacagttcaggaaaaagactcagactgaacacatggcatgagaagtttgatgaggccacttgagtgagaagaggttcaaggacagaacatgggagaatatcgactttcatattagggaaagtgttgaaagtggagagaacagagattaggagaacatctggaagacagaactctgaagtctaggatggagagtcccacagatgagattatccatagtagagtcccagagtcacaaagagatcctacagggtcagacatgggaaaagggcatggaatttgatgcgtagggcacagttgttgcaggggagtagtgtggcagaagtgaagagctatgtgaacagtaaggaatgggggcagggagagagcaggcagctgcgactggcctttcatttttcagtataattcgtaatattactattaaagtattttcctcccattaattttcttgcacctggaaaattattctctagcatcatttttatcaacctgtatgtttgtgaagaaactaaaacaagcagaaccatgaagaataattgagtggcaagaaagccttttataagaaagttggacatttgtaatgtctcaattcaaatcatcttatgtatgttttgtttaaatatagtttctgttattaaaaacaatattggtgggtaaatgaaagtttgcaatttagctttgggttacttttaactttcagaacgagattatgaactctgtgtgcatgcgtgcacatgggtgtgaatttcataaaaattatattttccaattgttgatgaagttctctttcccatttctgattttagttgaatgcctgttaatctaatagtaaaagacttttgtttcacaacctctgggaataccatgtagttgcagaatatgagattttagagacagaaactaacctggtggaaattcaaattcatcttttatcttttagataaaagcctttgaaatccttttagtgtgaagttatcagcaggcttgattctcatattacctcattactaacccaaggagttttcaaaatgcatagagaacaatgctctgtggctgaaactaggtttttatcactactccagtccagtgataagccaaatgtggcccacctagttctacttgggaaattctgcctgctcaccccgataaacctttggagatcatgagatcacaacacatatagaaggttctcataagttgtgcactgaagaaacctgttcgagtttatttgagcattttcaaaacttcttaaaccacagaacctttttccacattaacatttcataactcacctagggtttttgtaagataagaagtggaataaatgcttttgaaggattgatgcttcagcactgaggtctgtactgctggaagtgatggcagtgttctccatatatttttgtttcatggattggactgggtgaagtacaagaaaaaattcttactgcactgatctcccttctacccccagaatggcaaaaaatcagcttattaggtactaaggttttgcatgtgttcctgaaaaattatttttatcagttgttgcgtctactgtcattcaatggaatacgctctccattatgtataagatattttgttaaagatagaaaagtatgaacaaagaagtagtcatatcaagttcaccaattgttattttaaggcttacttaaaacaggataattcactacttgggggaaaaggctgatttccaaaactgcagctatgtagtgatttactcattccataagcctatgatcttatctgctcggatttacatttggagcagtaaaacctctggcagctgctcttagctgtctgcatgaagaggagacaggagataagaacattcctgattttattgctttctagaacatttgaagttggggtgggggtgggaaagatgaacctattgtgaccataaacgtccatcgagtctgataccaaagaagtaaaccagtcctcttagaagatgtggtaaatctcccaggccactggcctccatttgtcaaaacctgttaaggcttaaaaaagaggagagctgctgcctcttcttcaacagaaaagcaatcactccaatgttaagatagtttagggctttgggataattattgccaggtagaaaactttcaactattcttattgtgagctccccagatgaccttaccctactcccaaagagctccataggaccctgggcaaccttggagcaagcttcagcccaatccaactaacaattccagccgggatgcagtgtgggacagcatttaggggagggtgttgccacagactctgcccaggcacacctgccaatagcatcaccactgggaaagtggcagctcttagtacgacttaattggagaccatttgggattcctgtcaggtgagggtctctaggaagactgttaaaacccctgagttttgatgacttccaggatgtgttgaagggtctgtattagctcattctcaagacctaaaattttcttacgctttcttctttggacattagttcttcagttaaaagctgccaaaatcatgacagaatctggtgggggagaggggaggaatttgtattgcctaataaataatctcatagaaggtcataattccatattagccactaaatatctgaaatgtataaagcatgcaaagttggatccaagatgtggatgaaaaacagctcggtgacatttcttaagaattattcattttcttttttaatgtgaaagtagagcaagaacattctcctaaatcccagacttagagagctgaacattgcctggaggccataaagaattacattgacaaagccatttttctttagtttttaaattacacattaaaagttcccccaaagaattttggaagagatctcaagctttcagattcattagacatagagggacctctggaaactcccatcatggtcttcatctgttgtcctaggaagacactgaaatcatgctagggagaaacgaagctcctcaattttggaaaaatgttcattattgtttcagtcttcgtctgtaatgcaccctggacccagctatgctcattggcacaaagttttaaattgttctgctcttgtgaatagctgcttccccccaacacacacacacacacacacacacacacacacacacacacacacacacacacacaccagccactgctgtagtgttttatctccttgaggactactgttacctgcctaactcattttaaccctgagttctttgaacctctttgtcctttcatcttccttaaaattgctatgacttatacctcttaaatcatccccgcaaaaccactcatcccctaaaaataaaaatcagtccagtggcaaaatttgttgaaaggcaaggagaaaccattgtgtcttggtttatgggaataatgctgggcagagaaatcaatattctttgaaggttgtcctcctaccatggcaaagtggagctctccaaagaggtctttggggttggacataaactcaaagcagtgcacatcttatgtgctattagctcttttctggaatgataatgctgacactcctgttattttccttttaggcaggtttggtcaacatttcccatctcaaatatattttctctgttgacagagaccagatactgctacactcagcacacaatggaagtcacaggaaacagtatctcagtcaccaaacgctgtgtcccactggaagagtgcttatccactggctgcagagactccgagcatgaaggccacaaggtctgggcaacagagcaagtgaccagtactacatagccagctgccttctcttcagacatctgccagtactcatgagcagattcttactcccccgtgaaggctgtcttttgattgtctttatgctctatgaaaagacgcttcctttcctgtttactctaaaagaatacacatttataccagagcataggacaactgatataaattgtgtaaacacacatgaagagggtgttcagtgttattgtaataactttcttcactcagaggaaagtaataaagctaccagaaaaaagaggagcaagagaccagttatgtccatcacagtgaagctttgcagatgtacccagttcattcatcacaggaggaccgacgcaattcagctttgataactttctgtaaagtagggctcatgttgtgactgggatgttagtttggggagggtctccattggctcttgagtcatttgataggtgatggagacccatcttgtgtgttcgcttaagcttcacctggtacctgtagaagcctgtatacggaaacacatggtgcctatgtacagaagcactcagtgtaaaatgagcttgggaggcagccttgaaggggcatatggacaatcacagaaaggcagccttgccctctatacgtgtgtctatacatgtctatatgctgtctatacgtgtgaccttaacatagcatactttggcctttatttagcagctgaacacttctgcaggtggccttcctggtggtttgggcaatgtccattctcaatacctgggaacagcactgtttcttaagaaggcagacacctaattttcaagcaacctcttgaatacactaataattaaaattttaaatataatctgcctattctgctcctggttcaaaatgagtaaaaccaaaggctttccctgacctctccagcaaattggacttgattctgaggagttactgtggcctctttaccaaggagaaagttaaggattagagaaattgggtcatatgctcggtcacacagctggtaagtgacaggcacagaattccaactcacctctggtttggagtctacctccgcaacattatactgacttcctggcacgtgtcactgtgactaaagactcaaatccctgcaggaaaatgactgtatagaatgttattaataaccatcctatgactaggaatcacctgggaatcttgttaaaatgtagtcctaattctttgtctggggcaaggtttgagattctgcacttgtaacaaactcccagctgatgttggagctgctggtctgtactttgtgtagccatgccccaagaaagtttttgtcactaactctgtgggtttatttctttctaatgatccacgagtaaggtggtgtaaagcaggagtaactgcatgaatgaaaacccttcaaacattaactcacccaatgagaatggagacacttatgcaaacagttctgtgaaagtcagtactcaagtttaaaccacccgggttgttgccacttgactctcacttgaaaacttggcaaacgaaggcttaccctctcttcctcaagtagtcagaaagagcctcatggaaaaacacggacgagtttctttattcccattttaagggcgaaagaactgaggcccaggaaggctatacacctttgtaagaatcgtatgggtggagggtgtcaaaaacaaaacctagctctcttgaagtttggcctggggagttttcatgttgaccagattgcttctagaagaaatattatccccagccttcctgaacgtagagttggcatctcctttatagattaggtaatttttacttgcatcttgccatgtgggcgacagtgccttcaaaaaccctgcctccttccaagacatgctggcttctcattatctttttttcttcctttctttcaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagactgtaagatattaggagtatgttataggggcatgtatagatgtgggcttttcaggagaaaagtaaccattggtttaaatataatcatgagttcatttgtagctttagaattttaaaacattgactccaaactgaatggactatttccttggaaattctgactgagtccctggaagagtagtaattccaacaattccagccatttgttcaattaattttcccaacattcttctcccagtgctgggaatcacatttcctctgttctgtgcagaagacaaaaaggcaatcataaaagtttgttatatttgtgggggtgcctggaggaggattttcctcaacttaatggagccactgtccataaagtggctgttatcccttcatataattggtgagatcagccttctccttgacttggcacctaattatgcttcatgagatcctagattccacctgagtcaattgtgtccagagccccaaaccaggatggagttgttttccccagatatggggttctattcagccatagataatctagacagaggatttcagaatgaaaggaaaaatgtgtggagattagtcctagttcattctgagggccgactaagtggctcagccagcttcttactccatctgcagttcatactgccaaagagctcccacttccaaatccccagtgactttatggagaagattctgcattaaattgtctttcgaatgatggggaagcaaggcataatatgcgatgatgaggagaaagtagaccagtgaggtgattgcaagactaacaaggagactcaatgggaagtttttctttcttttagatattgcttttgaagtagatggtaaaatttttgtcatccttcttgtattttttgtaccccaagttacaatttttcttcttccttgtaaataatttaaacagtatttatttttgtaaggcataactagaaactaaaatatattctaaaaaattcattattctgaacaaagtgatcaaattagaatacatatttttcaacagtggtagagcttttaatatatgtttattgaaagttatctataatacttgcaccagtgttgaaaaaagttaacatgtaggcaagagcaatatgtttgtctcaaggatttttccatggtttcctcagtgatggtgtcctggaattattcaggtggtgaccatcactggtctaagtttgtgtgcagggttttcagatgtgtttttgtgaaacttggtagaaccatggctaataaagaggacagtgttgtcagggtccatctgccctccatagaaaaatgtctctggctcataaaatgagactccctcagggactaaatatgaactgacagcagtaactctgatacagaataatctaaattgcatcaaatggccttaattcagagtttgttaggcttatcagtatgttgcttttaattggggtgggaaagtagagggagagaaagcaagacatttattaagcacctcgtatgtgccaggcactatgctaagcactttacataagttaggattaatccctgcaagaatcctataaagaatgttactagcatttacacttcccaaatgaaggtaccaaagctcaaacgcaatgttgtgaagctgtttccttcagatttaggttatgtgggatgatgtgggattgaagaggaaagaaaggtgggattatccccctaggaagactttcaggcctgacttcataggaattcatccatcttatcatgtggagtttatctcaccctgctgttgcaggatgctatttgcatgtgtccccaggtgatgttttttctttggggagtaggggtttggcttcctcattcatccctcttgctaaaagaggagatagttgatgttgcatctaaagatgctataagacaatgaaagtttgatgttgtacatacctacaagtaccatttttgtgcatgattacactccactgacatcttccaagtactgcatgtgattgaataagaaacaagaaagtgaccacaccaaagcctccctggctggtgtagagggatcaggtccacagtggtgcagattcaaccaccacccagggagtgcttgcagactctgcatagatgttgctgcatgtgtcccatgtgcctgtcagaatggcagtgtttaattctcttgaaagaaagttatttgctcactatccccagcctcaaggagccaaggaagagtcattcacatggaaggtccgggactggtcagccactctgacttttctaccacattaaattctccattacatctcaatattggtaatggcttaagtgtaaagagccatgatgtgtatattaagctatgtgccacatatttatttttagactctccacagcattcatgtcaatatgggattaatgcctaaactttgtaaatattgtacagtttgtaaatcaatgaataaaggttttgagtgtatcttaccaggctcctccctgcaaatgcacatgtcaatcaatgattaatgcacccaggttatgtacaaggcactgggcttagcaccacagggaacttccttccagaggcttgctttctagttgtgtagacaagaatacatgcatgagaagatacaagacaattcacccatgccaaatgattcatacaggctgtttaagtactgcagaaaataaaagaaggaaaggctaccagacttttcaataaggtctacagcttcccaagagcatgtctttgttaaatcaggaaatataaaaattatgtgtgtatgtgtatgtatatatatataccaccctattaactattttaaaatcgtattctattttgggggttgtgttaatgatgatgaaccagaaaagattttctcttgatggtttcttcaacaggaaacagatattggaatagtgtacatgtcatttttatctatacaatgaatttattatatttttcttagtaaagtgatagacattgaaagcaagcttgaa

SEQ ID NO: 1168 - DNA, 131643 bp, Homo sapiens
ggcctccaccgccttccccggctgcccggcagcctcccctcgctcgctctcctcttcctctagggccccagcgcagctcgggagcccgcgcaccgaggcgctaggggcaccgcgcactagagggacacccgccgcgcctggacagcccccggcgggcgcccccctcgcacctcctgccccgcgcgggccgcgctcccctcccccgcgcctgtgtccccagggcgcagggccgcgcgtccagccccagacccgccggggtccctggggacgcgccagcccggcagtggctcgacgatggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcgtgagtgccgacgggccgggggtggcggggggctcagctggaccccggcgcgtgcttccgccgtgcttctcgggatggagcctgctcagatcttcccgcgggctttagggaaccgtttttgctcagcctcgccttcttcccaaagtgaaagactctaaacaaggtccaggaaactcgggctgtcctgggaagaaagggttgtgatcctcaggatgtcttgctgtgggagaaattcagcttgttgggtcctctcggtggcggcggcagatcctgggagcaggaagcttggcttagtggctattgagtttgtgttgagtgtcagagacacctggtgcctttctcacctgatctccacgtggatggcctcctccctgaaaataaagcttcctaagatcaggggaagaggaaagggcttctttcttttcctaattatctccctggtagtaacattgaggtgagtcaggaaaattttactgaataaaatctgagtgccataacctattttaggaccaaagaggtcttttgcatggtgctgtgcacatcctggtttaggctcagaacattcctgggaaggaggcagggcatgggcgttcttctcttcattggagggcatagaggctgaaaactcacgtgatcttcccagaagtcccagccagtccttcatagctgagaaaggactggagtcctgtcagcagttagaggtggtcactgtttgagtcttcttcgtgtaccaggatcttgtcaagccctttagatgtcctcataccctcgtgtaatccaacgaccaccctcccctgtgaaggcctagagaggggacgtaaatcacaccggtggatggtgaagcatggattcaaacccaggcctgcctttctgcagggccgtgctcataactgcaagcagttgagacagcttccagctgccccagcagtgcccctctgtcatctctcacagacttttgttaaatatttgggaattgaaaatgagcctatgtgggagttagagaatgggcacaccatcatggtgcagaagtgactgaagacctgggcggttcctttgagaaacctgaagtaaatcttgtgtacctcaagtagcttgcttgctcccccagtctcagataccacccggacctgctctatgaagcccctggtggtcataatgcacataaggtatgagaagtgttggcttagctcctctcccagctggttccctcagcgagtattgaggacttcaggagactcaaaagctgaaggtattggaatcgccttgcagggcctagcttttaggagttcaacaaatatttgctgtgcaaatgaaggagttggcaggctcctctgcttcagcagcgcaaacaaaagctaaaatgacagagatgggccttctaccttggggtggatttgggccaggcatgaagtataacgcctttgggtttttttctgatttattatcgatatgctctgtgtactgcgctttttcaggaaatacaaaagtgaaagaaatgtaagtggcccacaatcccattactagaaataatcactgttgacatgttagcatgtatccttttagatttcattaagcgttttgaaaaagatgggaaaacatgtaagcaaaatcacccttattactactatagtttttatttttgacagagctaattatgcaccttttttgtttgttttgttttgttttgagacagggttttgctctgtctcccaggctgaggtgcggtggcaccatcatggttcactgccgccttgacctcttgggctcaagcgatcttcccatctcagcctcccaagtagctgagaccacaggcatgcaccaacacacttggataatttttaatttttttctagggacggggtctctctgtgttgcccaggctgctctgaaactcctaggctcaagcaatcctcctgccttggcctcctaaggtgctgggattgtaggcatgaaccactgtgccccaccttatgcacatattttaaagattcggtcctacaggcagaaatataagtttctcccagtgtcttcatctctttgagctctaaacaacgtgtttataatgctgtttattggtgttccctcacccacccagtcatagacattatccattgcctttctactctgaaagatgaggctttagctgggatgccctcttccctgcctccaattatacataccctcttcctgtctcccaatataggtccaaacacttctgatggttcaacttaggaattttcagctttacagatgttgtaaaagcagtatgcattcagtagaaatcatacttcgaattttgaattttggtcttttcccaggctaatgatattcggtagatattttttcatgatgctggtcagctctcagccacccatgccatcaccagcgcaaaccacccatcctctccagcatgctgtgctgctgggtgattctgccagctgtaggctaacctaagtgttctgagcacgtttaagataggctaggcttagctatgatgtttggtaggctaggggtattaaatgcatttttgacttcggatactttccacttaggatgggtttatcaggatgtaacctcattgttaagtcaaggggcatctgtatagtcttcaggtgatttgggttagatcagcagccagtgttgacctatgacactgtaaataccacttacaactgacccagtgcgtagactatgaatgcttttcctttcctgcccaatttcttgtttgccctggtgttagtaattctcttttctcatttcataatttctccagatatttagtcactaatttaaccctagttgtttaagtctcctatcaagaagctgagagacatcaggtattctgtcagaatcgtcttcatgactggcctctctgggagcctctggcctggtggcctgcacacagctggccgactgggctctcctgcaccatcactctgaagattctcttcctttctttcctgggttggatcctctgcttcccatgtccagtgtcctctgtcttgctttgctcccactggggggacacacagcctcttgtagttttctaagaaagcatgcatgtggaaatggaaatttgcacctttcagaatagcttgattctatacacaattcctagttcaactaggtagagagtgttagactgaaaatgtttttcttcagaatttaaaatgtattcttttattgtcctttagctattctgatttaattttgttttgttttgtttgagacagtgtcttactctgtcatcaggctggagtgtagtggtatgatcacagtgcaacctacccctcctgggctcaagtgatcctcccacctcagcctcccaagccagctgtgaccacaggcatgggccaccatgcctggtggatgatttttttgtattttttgtagagacagggtttcgccatgttgctcaggctggtctcgaactcctgaactcaagtgatctgcccacctcggcctcccaaagttctgggattataggcatgggccactgcacctggctgtaaaaatttttatttcaattatttatctccctctaccccctgacttctggaaatgtgttgaaccttctttttcccagagatctaaaatatcacaatgatgtgccttcatatgagtgtgttttctcccagtgtactgggcacctggtgtgttctctcaaataaggaaaattcacgtaagtttcaggagactcctccccatttttacaaaggtattttagtaaacaaaatacaatttttttttttttttgagacagagtctggttcagttgcccaggctggagtgcagtgggtctcataatgtcactcaggctggaattgcagtagtgcaatcccagctcactgcaacctctgcctcctgggttcaggcaattctggtgccttagcctcccaagtagctgggattataggcgtgcaccaccaagcctacctaatttttgtatttttcatagagacagggtttcgccatgttggctgggctggtctcgaattcctgacctcaagtgatccacctgtctcagcctcccaaagtgctgggattacaggtgtgagccacctcacctaaccaaaataaaatgatagctctcttaaaagtttataaaaataaacatttatacattgttggtcaggcgtggtggttcacacctgcagtcccagcactttgggaggctgaggccagcagattgcctgagcccaggagtttgagaccagcccagccaacatggcgaaaacccatctctactgaaaatacaaaaattagcccagcatggtgctgggcatctgtagtctcagctactcgggaggctgaggcagaaggatcatttgaccccaggaggtcgaggttgcagtgagctgggattgcgccactgcattccaacctgggtaacattgtgagaccctgtctcaaaaaaaaaaaaaaaaaaaatcacattcttttaaaagtataggttgggagtgtatcctcggacacatttttggataattgtcttctcttctcagctgcagtccactcagactgacttttacattgtgaattcaggaaggcagtacagctcactgtggttgaatgcatttgacctgtgttcagtttctggttctgctcttcaccatgtacagtgtgagccattctttcaattcgaaagtatctcatagagttgtcaggacccaaacaacacagctgtgcatgaaatgcttagcaaaataccctggattactcttcagttatctccttctctcattgatgcctctcttcagcttccagttttgctgttttgcttccagccttttcctttggtatattttaactccagcaaatgccagacagagaattaatggtttctctgccaagatattatagcagcagggatgagtattcaagcatcttccagttcatggtagaccaactttgaattcactcctgatcaacatagctgccccctgcgccgccctgacaagtacgtgaggagagggagctgtggaaggtcaggtccagggagctagaaggtttgatagtttctggctgcagaaccacctgcacttgccctgcacaccaaccaagatcttacctaaggagtttttttgagacagagtctcactgtgtcacccaggctggagagtgcagtggcacaatcatagctcactgcaacctggaactcctgggctcgaacagtcctcccgccacagtctcctgaggaactgggattacagacatgcactgccaattctcagctaattttttgtttagaaacgggggtctcactgtgttgcctaggctagccttgagctcctggcctcaagcagttctcctccttaggcctccaaaaacactgggattgcaggcatgagccgttgcggccagaagattttttgtttaattcgaattttctctttccattttctcagttctttctaaaactccttttatacttttttctttgcatatattttctcatgatttttttctaactgatctgtgatatgctgtttgcttttactatgccgtgaacatttttcagggtcttggaccttttgaattattaccgttttctgtcgtaaagaagtaccatacctggtttccccagttttctattttaaaactaatgtgtttctagggtttactagcataaccagtgctgtagcaatctttttctttgtctgtctttccacatttgtccagtgcttttcttgaggaaaagttccttgaggtagaattgttgggctaaagggtatataaatctaagggttttgtgacatagtctgaagttatcttccccaaagttctactggttgaaactgtcatcagtagtatgagccttttaaactaaaaatactttaaaaaaattccaaatgttaatgatcaccttaaataacgtactgtgttttattgattataatgggtagtttttgttcatgttttaatatctgaatcaggatactgcttataattgatggtttcttggatgtcatgaaatatggacccattgattctttatctggggatacaggagtgtgtctgtttcaaacctttgcaatcccattcctgagactaagatatacctacccccagaaaaatgctactttctgccttgtgaaaacaaaatactgagacaaagaattactaagaacctgacttcctgcctgaacctggggaaatgaaattaggcagagaacaaagcagtgttttttcaaatcacttgtcaaaatcgcttgctctggttttgggggtgagtggtagtagctgtacctattaaaacactcaaggctgtgccaatgtaacatcatgtggaaaccaaatcatggtagtttccttccttttaaagttttataacaagctagaagcaatccagtacttgacctgtgaattgtaggatgctgtgatctcataactattacaagtacttgaagaatgaaagtgatttgtaagaatcttagtaaattgtgcccttcctgttattgatgacttcgaaatgaattatagtatccatgtaataatgttaggtcaccttttatttatttactgtcttgagcaaacttagttggggaaggataaatagggtttactgagagttggaattttaattattctgttgccctgttgagttcctttaaaaaatagtgaacatagtttccatttcataaaagcaatacccgacatttgtagaaaaaacttttatttattattattattactttgagatagagtcttgttctgtcccccaggctggagtgcagtggcgtgatcttagctcactgcaaccttagctcactgcaacctctgactctcaggttcaagcaatgctcatgcctcagcctcctgagtaactgggtttacaggtatgcacaccactgtgcctggccaatttttgtatttttagtagagacagggtttcacgaagttagctaggctggcctcgaactcctggcctcaggtgatccacccaccttggcctcacagttgttccagaatttaagttatatattatctgtaattgttttttaaagcatactctcttgtaaactactctttttgtttcctgctgtgaccatctgtgctggataccttccatttgtccttcacattccctctccaccctgatcctgcatggacttattaagggcccccctgccatctgatgtcccactggccgcatctactggtgtcatcagcatgaggctgttgggtgagaggagagcaggttctggacattcattccccagggttcctccctgctgggtctctgctggttgtctgcgtccctccacagaagacaggctacctagcagctctcggcacactgcttttttccctgagtttgataactattcgctcacccctgcttctgattgccaagtactgccctatagcttgtggttttcctgtaccctgctttataaacaacacccttattaaaccctactcagattacccaatctgaatgtgcctgctttcctgctgagacctgatatattacctgttttcatcaatgattaatttcttatggcattcataatggccacatagtattccataaatatccaggctcctactgttcaatgtatgtttatttcctccttttaccagttccataacatcttttaagctaaatctttctggatgttctttagtgttttctgaggatgattacttagaattgataagagggtatatgaatcttctttaaagataagtttattggctgggcatagtggctcatgcctgtaatcccagcactttgggaggctgaggcaggaggatcacctgaggtcaggagttcaagagcagcctggccaacataacaaaactcatctctactaaaaatacaaaaatcagctgggcgtagtggcaggcacctgtaatcccagctactctggagactgaggcaggagaatcgcttgaacctgggaggcagaggttgcagtgagccgagattgcaccgctgcactctaacctgcgtgacagagtgagactatgtcccaaaaaataaaaattaaaaaaagataagtttattaagatatacagtaaatccacattgtttagtgtagagttctatgagttttggcatttgtgtttttgaaaaatagctttattgagatataattacatataaaattgacctttttaaagtctacaactcaggggtttttaggatattcacagagttgtataattatcaccactgtcttattttagaattttttttcccctgagatggagtctcactctttcgcccaggctggagggcggtggcacaatctcagctcactgcaacttccgcctcccaggttcaagcagttcacctgcatcagtgtcctgagtagctgggattacaggcgtgcgccaccacacctggctaattttttctttttttttctgactttttagcagatatggagtttcaccatgttggctaggctggtctcaaactcctgacctcaagtgatccacccacctcgacctccccaagtgctgagattacaggcgtgcaccaccacgcccagctaatttttgtatttttagtagagatgaggtttcaccatgttggccaggctggtttcgaactcctggcctcaagtgatccatccatctaggcctcccaaagagatgagattataggcgtgagccaccagacccagctgaatattttctcttttaaaaattttttgaaatgtcttcctactgtcactacccttattcaaagaacattttcatccctcaaaaacaacctcatccctattagtagtcactccccattcctcccttccctcaacctttggtaacaaccaagttactttctatctttatgaatttgcctattctggacatttcacataaatggaatcctatgtggcccttttggtctgacttaattcacttagcatcatgtttttaagggtcatccctgttgtagtatgtatcagtacttcattatttttaaattgtcaaatatttcaatgatgtatacattattttatttactcatcagttgatggagtttataataggtacttcgtgttcatgttttaatatctgaatcagggtgcagcttataatggatgccaaattcatatactgctaaaacaaacaaaaacctggcagctgggatttcaatctggattctgttgcgtctatagatcaatttggtgagtactgccatcataacaaaatgaagtcttataacctatgaacatgggatgttcatattgcctattacgaataatgctgctgtgaactttcatgtataagcttttttttttgacacacagtctcactttgttgcccaggctggggtgcggtagcgcgatcttggctcactgcaacctccgcctccccagtttaagcgattctcctgcctcagcctcctgagtagctgggattacaggcacccgccaccacacctggctaatttttgtgttgttttagtagaaactgggtttcaccacattggccaggttggtctcgaactcctgacctcaggtgatccacctgcctcggcctcccaaagtgctgggattacaggcatgagccaccacacctggcccatgtttttttttttttaattaaaagtgtttttttttagagacatgatctcactctgttgccagcctgtagtgcagtggcatcatcataactcattgtaaccacaaactcctgggcttgagcccaggcctccaagtagctaggactacaggtgtgggccactatgcctggctaattgtttaattttttgtagagacagggtcttgaattcctggcctaaagtgatcctcccaccttggcctctcacagtactggattacagtcatggcccactctgcccagcccatgtatgagcttttatgtgtacatgtgttttcagtcctcttgagcatttagcaaagaatggagttactgggtaatgtggaatcttttttttttttttttttttttttttttgatacggagtctcacgctttcgcccaggccgcactgcaggcctggactcccaaaggtaatgtggaatctttatgtttaatattgaagtggctcagtgtcgtggctcacgcctgtaatcccaccactttgggaggtcaaggcaggcagatcgcttgagcccaggagttcaagactagcctaggcaacatggtggaaccccatttctacaaaaaatagaaaaaattagctgggcacggtggtgtgtgcctgtagtcccagctactcaggaggctgaagtggggggatcacttgagccagggaagttgaagctgcagtgagctgagattgtgccactgcactccagcctgggtgacaaagtaagatcctacctcaaaaaatgaaaaaaaaaaaaaaaaattgaagcactgctagactgtttccaaagggaccgtactgctttacaatccctgctgcaacatgagagttctaattcttcacatcctcatcaagacttattttctttgattctgaccatcctagtgaatgtgagatcgtatctcattgtggtttgggtttgcattttcatcatgactaatgatattgagcaatcttcatgtgcttagtggtcatttgtacattttcttcagagagctgactattcaaatcctttgcctattttaaaaatgggttaatttgtcttttattgttgagttgtacaagttctttatacattctgggataaatcccttatcagatatatgatttgaaagtatttttctcccattctgtctgttatcttttcacttttctagactatgtccttagaagtacaaaggttcttaattttgaaaaagtccaatttttatagtttttcttttgtcatttgtgcttttgatgtcatatctgagaaggctttgactaatccagggtcacaaagatatactctctattttcttctaaaagttgtaggtcttatatttaggtctatgattcgttttgagttcatttttgtatatgatgtgagggaagggtttaacctcaatctttcacatatggatatcaattgtcccagcaccatttattaaaagactgtttttctcccattgaattatcttggcactcttgttgaaaatcaaatgatcataaatataatggtttatttctggattctcagttatatttgattgatgcacatctctactcttatgccagtaccatgctgtattgattactgtaactttgtagtaagttttgaaattcaaaatgcgagtcctccaacttggttcttttttaaagttgttttggctattctgggccccttgcatttccaaataaattttaggatcagcttgtcatatagtaccaaaacaaactaccaaaaacctggcagctgggatttcagtctggattctgttgaatctatagatcaatttggtgagtactgccatcataacaagatcaagtcttataatttatgaacatgggatgtctttatatttatttaggtcttctctaatttctttcaacaatgttttgtagttttcagtatacatgtcttgcccttcttttgttaaatttatttctaagtattttattctttttgatgctattttatttctttttgatggcagtattttcttaaattcatgtttggattgttcagtgccaggttatagaactccaattgagttcttttttatttctttcttttattttatataaaaaatttatacaaaaaaattatagggtttcaccatgttgcccaggctggtctcgaacccctgagctcaaatgatccacctgtctcggcctcccaaattgctgggattacagccgtcagccatcatgcccagcctccaaatgagttctatatcctttctgtggtattctataactttgttgacctaatttactagttctaataattattttgtggttcgacatatgtttttaaggcttttggtgttgctgccaaagttatacaaaaaagttcataccagtttgcatcctaatggtgtttcagcatataacaagatttgtttctgcaaatactgaaattttcttttgatatttgccaacttgtttggggtgggagatatttggaataataaaaaccaatttggcatgggcaccaactggtcagagagaacaccagctataaataatattcaggggagcctgaacatatgaaaaagagcaaattgtttttatttgcatttctgtgatcattaaagttgaacattttaaatatgcttattagacatctatttttaattaattcattcattttttttgagacagggtctcactctgttgcccaggctggagtgcagtggtgtgatcattgcttaccgcagcctcaacctcctgggctcaggtgatcctcccacctcagcctcccaagtaactgggactacagacacatgccaccacaccccgctaattttttgtatttttggtggagacaggttttgccatgttgcccagattggtcttgaactcctgggctcaagcagtccacctgcctcagcctcccaaaatgctaggattacatgcctaagccaccatgcccagccacatctgttactttttattattattcatgccactttttttgtcagaaattctaatttgtatgaaatctaaactgttatcttcctttagccttctgggcattacttagctaaacagggcttcccaagccacaaggttacacaaatatttgaagaaaatataggggaatttttttttttttaatatttacttttttggttgggtgtggtggctcacacctgtaatcctagcattttgggaggctgaggcaggcggatggcttgagctcaggagttcgagactagtctgggcaacatgatgaaacccggtctctacaaaaaacacaaaaattagctggtcatgatggcatgtgcctgtagtcccagctacttgggaggctgaggtgggaggatggcttgagcccaggaagtggaggttgcagtgagccatgaccgtgctgtcactgcactccagcctgggcaacagagccagaccctgtctcagaaaaaataaaaaaaatttaccgtcttaaattttaagaagtctttttgtgtgtataatgtaagaattttacttctttacccaagtggatatccagttgcatcactattaatcatattttatttccttatatgcagaactatttcttaaccctatcttgttctattcctgtgtgaattcccaggcccttttaattattatagtgttatcatgtattttaatattcaatagggtaagccatacaaaattttctatttctttgctatcgctgtatacttatactaacattcaaggtgatttttagaatcaatgtgtcttaaattccatttcaacttggattgtgatttcattatatttataaactaatttgaggagttgactttctgatgccaaatcttaccatctgggaatgttgtatctcttcatttattcaggttattttatgttcttaaagtgctgagttttttccagatgaatcttaggcatttcttactcagttttaagtattttcaatttctgataaatgggatttgtcaaaaatgaattggatttcactcatttctgattatttgtgatttataagaaagctgttaatttttaaattttggtcttgtgtgtagctatctcgagttattctcatactttttgaatatgggtggttttcattttctttttatacttttttccattattgcataggctaagattgccagtataatgtcaaataattgggatgatgtagatatccttggcttgctcataactttaattggatatttccaatattatgatagtacagttttaactgtagggtctgttattctttattgagttaaggaagggaagttaactgtgtaccctttttaattaggaatgatttgagcagtatgaatgggaatggacctaggagataggattgttttggtggggaagtgctttttattgaggtgatcatttgaggtttgtttacttccattggctaatgtagtgaattgtattaggaaacctaatgttgaattattcttgtactcttgggataacctctacttagttgtattattttgataaactattgaatttaaatgttttttactcttggatttgatttattaatatcacatctagggatatcgtggctatgtgcatatgtaaaatcagccttagtttcctttgctatattccattttgtctgattctaatcctgtcagaccagctttttttgtagcatttatttattttcttgtccctttatcttttttttttttttttggagacaaagtcttactctgtcacccaggctggagtgcagttggcgcaatcttggcccactgcaacctttgcctctaaggttcaagtgattctcctgcctcagcctccctagtagctgggattacagtcgtccgccatcatgcccggctaattatttttgtatttttattttagtagcgacagggtttcaccatgctagccaggctggtctcaaactcctgacctcaggtgatccacctgcctcagcctcccaaagtgctgggattacaggcgtgagccaccatgcctggcttcttcatctttttaaactaatcgtggtaatttattttcaccatgcatttctccaatttctttttcaagagaccaggtcttgctatgttgcccaagctggagtgcagtggctgttcacaggtgagatcatagtacacttcagctttgaactaatgacctcagacaatcctcccacctcagcctcccaagtagctgggactgcaggtgagcactaatgtgcccagcttgtccctttatgtttttatttttttcaggggggaggatggagtttcacgcttgttgcccaggctggagtgcagtggcacaatctcagctcactgcaacctctgcctcccaggttcaagtgatcctcctgcctcagcctcccaagtagctgtgatcacaggtgcacaccaccatgcccagctaatttttgtatttttagtagaaatggtgttttaccatgttggccaggctggtctcaaactcctgacctcaggtaatccacccacctcggtctcccaaaatgctgggattacaggtgtgagccactgcacccggccttgtccctttattttttaattgagtgggatttgtataacataaaattaaccagtttaaaatgaacaattgagtggcatttactacatttacaatgttgtataattgccacttctaattccaaaacacttcatgttctccaaaaggaaacaccccttttattttttacctttccttgtcatcttgttataagtacatcttctatatgtatcatatagttagattttatttgtatacccagtctgagaacgtgtctttcaatatggaaatttaacacatttatatttattgtgattatttagaattcttagttttccttattttttcctctagtgattgaaagttataaattctattttgtttggagttactttaaaatttttaccccaaattttaagctcataattttctaaatatccagataattaatcatgatatataattatatgattccattcaaaagacaatactttcctccttacctattcctggccacgtactttgtgtcagccaactttctctggattaaaaaaaaaatgacagctttattgagatacagtttacatactgtaaagttcacccattcaaagtatacaactaagtggcttttagaatattcatagcattgtgcaatcatctacactacaactacttttagaacattttcattaccctaaaaagaaaccccatacccactaacatatattctccatttcttcccaaatcctccctccaccatccctagtcagctactaatctactgtctgtctctataaatttgcctattttggacatttcctataaagggagtcctataatatatggtcttctttgacttatttttgtggcttctttcacttagcatagtattttcaagatttatccatgttgtggcatgtatcagtatttcatttctttttttttaaccagctaatagtccattgtgtagaaataccacattttattcatctgttcatggacatttgtttgtttctgccttttaactattattaataatgctgttaagaatatttatgtagaaggttttgtgtggatacatatttttatttctcttgaatatatttcatgctgttaagagtggaaccgctatcatcatatggtaaccctccatttaactttttgaggaactgccagactatttttcaaagtgtgtgtgccgttttacaatccctgtactactttttaaaaaatgatttcttaggaatcattgcttggcagtcatcttaagattcccacccatattactgaacaactatttagacttaaccacaaatttaaatttgttcacactattacttttcatgttattttttgtgtcacgtactttcttgatttttcattttgctggaggtacctttttgagtaattattttagaaagggtttgaaagtggtaaactttttgagtcattgcacatccatttcatctttcttttaccttcatacttgaataataatttggttagtataaagctatagatctcaaaatttcttttcattaatttttactcagttatttttttggaggagtgaggacaggatctcaccatgccacccaggatggagtgcagtgacatgatcttggctcactgcagcctcaacatccacaggctcaggtgatcctcccacttcagcctcccgagtagctgggactacaggtacttgccaccatgcccagctaatttttttgtattttttgtagagacaggatttcgccgcattgcccagtctggtctcaaactcctcggctcaagcaatacgcctgcgttggcctcccaaagtgctggggttacaggtatgagccaccgtgcccagccaagaaaattttttaaaattaattctttgaggatattgttccattgtcttctaacatccagtgttttttgttttttggtttgttttgttgttattagggtgtcactctgtcacctaggctggaatgctgtggctcaaacatggctcaatgcagcctcagcctcctgtgcaggtgggatcacaggtgtgcaccaccaagcctggataatttttttttattttttgtagagataggagtctcactttgttgcccaggcgggtctccaattcctgggctcaaggaagccttctgcctcggcttcccagagtgctgggattacaggtgtgagtcactgtacctggctgcattcagtgttgttaataagagacttgatggtctggtagtatctaaacaggcctgttaggctcagtacctcccagaccttgtccattcatgaatgtgcattcccacagacttcgttacagcagagtcttgtgtgaatgatgtcttgcactactacccatgcaaatgtagcactggtggtgtagcaataaattgtaggtgaaatgggagtgttatatacaggagaaatggcttatgaaaggcagttttgtaaccatgtaagataattatagggaagtttcttcaggttgatgtggtttggaataaaagattgttaaaggcttccttcgagtttcccaagtcctggtgggatctctccctgccctcactctaatctgggaggacttagggagacaaagttccttctctcaagacagctctagcctgatatttcctggtgttccctgctgagaatatattccttgcatctattgcagtaaactgtaacttctataatgtttgtcagagggctagctttcactgggcttcaaatccactcctctgtgggaatcaggttctcttttccttttaagtaactaaatggtcttttttccctccctagaagcttttgaaattgtttccctatcttcagggatctatggtgatatctccctagataccactgtatgtctggaagaagcatgatctcagatcactgcaacctctgcttcctgggttcaagcaattctatgtcccagtagctgggattacaggcatggccactatgcccggctaatttgtgtattgttgttagagacgggtttttgccatgttggcccagctggtctcaaactcctgacctcaagtgattcacccacctcagcctcccaaagtgctgggattacaggagtgagccacaacactggaaaggcattctttatttgtcctccttgccactttttgggctctttataagtactatacaaatctagcttcggcatagggagatttctcttattttctgcattggttctttgttttctccactaaaggaatctttattcaatccaggaggtccaggagagattaaactgtcttcaatatctcctaatttttctttcatatttctctttgtactttgcaaatagtgtaattttctagaaaaattacactttaagcccaaattcaaatttccagttaagtatgctctgcctttcaacccatctattgctttattatggttttaatagttttaattcccaacaattagtcattctaaaatgtttgcttttagtctgatctcttttttattgaatcactttaaggatcttgagtgtattttctttgtttaccgagagaccacttctgcttgttgaatctgttgcttctcctgtgctgttttcttcagtcatttggtgattaatggttgtccatgtttgtaatagtagatgagatgactggagactgtttgctcagcttaagtgagaatctctgtacctcggcagtgaatacaggttttcatcgtgtgatatgcatctggtggtttttcagaggaaaggaaatattggcagggctgggagggggaagctagggtagtggggctgcatgggctttcttaagatgtgtgcaaatagcttattgaagcatctggaaatctcaaatctttatcctggggactatttccagaagtcgctgctggagggaggggggctttaaatgtactctttagcagattacccttaactcattccctctccaactttggttattgcttctaatctttggtttatctgggggtctgtttggaggactgtttttttcagtaggtcctctattttctgctccagagctgcagacaagaaactcccttgcttatcatagtttgttctcaagtgccttccaggaagttctcactgctccagactgctgttgctgctttctagcttttcggcactactacgtatttttttaatttgggagtgggagacatttcagtggaatttgggaaggataaagaggtcctagctacaaagaagttcagtagttttgttattcacttatagacattttgaacatatataaggaataatgaccctctttctgtgttgtgaatattttttctagcttgtcccttagttttatttacagtgctttgttttttttgttttgttttgttttgtttgtgatagtcttgctctgtcacccaggctggagtgcagtggcatgatcacagttcactaaagcctcgacctcccaggctcaagtgagcctctcactttagcctcctgagtagctgggactacaggcatgtgccaccatgcctggctgatttttttaattttttgtggagatggggtctcagtttggtgcccaggctattctcaaacttccgggctcaagcaatcctcctgctttggcctcccaaagagccatagtgactttatttacaaaatctaaagtttatcttcaaatctctcagtcttactgttttccccatgttgggtgtcatccttagaaagtactatctcactacatgtcggcaaagcctgagttctgtcccctcgcttccccaccccactgcccccggacagcgtgagcttcaccactcgttccaccttctcctccaactgccagtccgtgggctctgtccaggggcccagctactggcatccagccagtcagcagtgcagcaagcatctatgcaggcgccggagggcagggggtggctctggttcccggatcaccgtgtcctgctccaccagcttccagggtggcatggggtccggggacctggccgcagggacggccaggggtctggcagaaatgggaggcatccagagcgggaaggagaccacgcacagcctgaacgactgcctggcctcctacctggacaaagtgaagagcctggagaccgtgaactggaggctggagagcaaaatcccctgaagggaccccaggtcagagactgggccattacttcaagaccatcaaagacctgagggctcaggtcttctcaaatactgtggacaatgcccgcattgttctgcagattgacaatgcctgtcttgctgctgatgactttagagtcaagtatgagacagaactggccatgtgccagtctttggagaatgacattcatgggctcttcaaggtcattgatgacaccaatgtcactcggctgcagctggagacagagatcgaggctctcaagaaggaactgctcttcatgaagaagaaccatgaagaggaagtaaaaggcctacaagcccagattgccagctctgggttgaccgtggaggtagatgcccccaaatctcaggaccttgccaagatcatggcagacatccaggcccaatatgacgagctggctcggaagaactgagaggagctggacaagtactggtctcagcagattgaggagagcaccacagtggtcaccacacagtccgccgaggttggagctgctgagatgccactcacggagctgagacatgcagtccagtccttggagattgacctggactccatgagaaatgtgaaggccagcctggagaacagcctgagggaggtggaggcccgctacaccctgcagatagagcagctcaacgggatcctgctgcacctggagtcagagctggcactgacccaggcagagggacagcaccaggcccaggagtacaaggccctgctgaacatcaaggtcaagctggaggctgagatcgccagctaccatcgcctgttggaagatggcgaggacttcaatcttggtgatgccctggacagcagcaactccatgcaaaccatccaaaagaccaccacctgccggagagtggatggcaaagtggtgtctgagaccaacgacaccaaagttctgagacattaagccagcagaagcagggtaccctttggggatcaggaggccaataaaaagttcagaggtcattggaaaaaaaaagtattatctcgctaacaaagctaaatataatgaactatacgttaatattttgcctatatttttcatgtgctttaaaatatttaactttaatattgaaatgcatttcagcagaaatataaagttgggctctaattttgttttcaaatgtctactcagttgtcccaacatttcatattggtaaattcattgtacattcccttacctggattgctttctgtttttcatttactacttgtatgtgcttgggttcaactgtatactttctagtctgttctactctttgtttcaatgttttaatacctgtagttctagattacatgttaacatctgataggataatctatcccagctgtgatttttttaaagttttttttttttccccctgttttcacatgtttatatgtttcttcttcaagtagagctttataatttttttcacagtcacagctggtgcctcctttcctttgttagattatattggatttttatataacacatagattaattttgggaaaatcattttatactaccctagttcctaagagggaaacttttcagctatttctttgtctcaggttatgtcttagtattcattcttaagctcctcaaggtctttcccagtctaaaatgctatgaaggttggatacagtggctcatgcctgtaaccccagcactttgggaggccaaagtcagaggattgcttgaggccaggagtttgagaccacactgagcaacgtagcgagaccatgtctctacagaaaatttaaaaatgagccaggtgtggcggtgcatgactgtagtcccagacacttgggaggctgaggcaggaggattgcctgggcgacagagtgagactgtgtccatctcaaaaaaaaaaaaaagaataaaaactaagaaaacaaaatgctatgagttttacaatccaagttaataatacatatcttgtgtattgtcataaaaatgtgttaaatatttaccgtgtgccagaatctgtgtctagcccttagaatatagtggtaaatagcacctttctatgtttatttaaacaaatgatcaattataggaattaagacatgtaaagaaaaatatgcttaaaaatatattaaattatagtaggaaaaactcaagttttcaaatttgaggtgaaattcaagaggcatttattccttgtaggcatttggtcctttattcaccccatagagagggttaaatctaaaatttgacaggaaaataccatttgtttgtttgtttttgctaagatttatgagtagcactgtttctaggaaggtgcccgtacttttccttagatgagcactctaccatttaaagggttttcacgttcattgtctcagttgataataaaccagtcccaggttatggggaatccctcctttctttcatttccatttctacttgaaccatgatttgaggaaacagttcttaaataacacatgaatgagtcaaccacacccttgtggagttcagtgtgaaacaaatgccatccgattgcttgtccatcctctgtacacacccatgagattcatggtgccagcctagtaatatgtccctttcatgggaaagtagaatattcattgtcttagagttcaactgaagatgacaatctactgtagctggttgaagccgcaagggatttattatgcatcattagttggcttccaaaatttttggtagggttggaggagcaggctctaggctgagcttccaggagcacctactggaatcataccatggaactggcctgccatcagaaggaagacgaggaagcaggatctactctcatgtctgctgggtcctggatgtccattgtccccattgcgagtcatgatatcacatggctgccccctgacttgcctctcaacaccacgaagcgaggaatgggacgctgggatttcagttttctgtggactgccacagaaaaagaagtaccttcttggctatgtctgccagcaggaacaaagaggcatccaaagcatgtcctttgggccatggcattgtctttttccttctaagtctaggatgggtgtgtctgctgaagctacatcattgtgtggaacctgagctgtggtccagctttccagcctctagtgagcagtaaggcacactgcaaggggaatgtggcagaggtgagtggatccacatggagtatttactacatccacttcattggattctacctggatcactgtgttggaggtggaaggccatctgtgatttgtggtgcttctaaaacattctaaggacgtgccctatttcagttaagacacacatttgatttctagctatgcaacctttacaactgacctgatacttcctgaacttccatctgtaataatgagaaagataatgacgatgtcacatgttagtagaagataaagtgagcaaaaatacaccgaagctctgtctcagaggaaaatattagcttatttcttgggttactgtaggcttatttcttcccttttttaatcagccggtccaaatattgtacattaattccccctggactgggctgtatttggaatgagtggtcatatcagcttctagtgagttttcacacactcagcaatgagcgggaacatagaatttagcctctctggtacatactagggttaggattaggatcatacttgtaactaaagaaagcttaaaagctatattaaaaaccacagagcagggcagttccaaaatagccgaataggaacagctccaatctacagctcccagtgtgaacgatgcagaagacagatgatttctgcatttccaactgagattggaagacagtagcggttctctcagcacgcagcttgagatctgagaacggacagactgcctcttcaagtgggtccctgacccctgagtagcctaactgggaggcaccccccagtaggggcagactgacacctcacacagctgggtacccctctgagacaaaacttcaagaggaacaatcaggcagcaacgtttgcatttcaccaatattcgctgttctgcagcctccgctgctgatacccaggcaaacggtctggagtggacctccggcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaaacgagcagaaaaactgaaaattctaaaaatcagagcgcctctcctcctccaaaggaacgcagctcctcaccagcaacagaacaaagctgggccgagaatggctttgacgagttgagagaagaaggcttcagacaatcaaacttctccgagctaaaggaggaagttcgaacccatggtaaggaagttaaaaaccttgaaaaaagattagacgaatggctaactagaataaccaatgcagagaagtccttaaaggacctcatggagctgaaaaccacggcacgagaactacgtgacgaatgcacaagcctcagtagccaattcgatcaaccggaagaaagggtatcagtgatggaagatcaaatgaatgaaataaagcgagaagagaagtttagagaaaaaagaataaaaagaaacgaacaaagcctccaagaaatatgggactatgtgaaaagaccaaatctatgtctgattggtgtacctgaaagtgacaaggagaatgcaaccaagttggaaaacactctgcaggatattatccaggagaacttccccaatctagcaaggcaggccaacattcaaattcaggaaatacagagaactccacaaagatactccttgagaagagcaactccaagacacataattgtcagattcaccaaagttgaaatgaaggaaaaaatgttaagggcagccagagagaaaggtcgggttacccacgaggggaagcccatcagactaacagctgctctctcagcagaaactctacaagccagaagagagtgggggtcaatattcaaaattcttaaagaaaagaatttttaacccagaatttcatgtccagccaactaagtaagcttcgtaagtgaaggagaaataaaatcctttacagacaagcaaatgctgagcgattttgtcaccactaggcctgccctacaagagctcctgaaggaagcactaaacgtggaaaggaaacccgtaccagccactgcaaaaacatgccaaattgtaaagaccatcgaggctaggaagaaactgcatcaagtaacaagcaaaataaccagttaacatcataatgacaggatcaaattcacacataacaatattaaccttaaatgtaaatgggctaaatgctccaattaaaagacacagactggcaaattggatcaagagtcaagacccatcagtgtgctgtattcaggaaacccatctcacatgcagtgacacacataggctcaaaataaaggggtggaggaagatctaccaagcaaatggaaagcaaaaaaaaggcaggtgttgcaatcctagtctctgataaaacagactttaaaccaacaaagatcaaaagagacaaagaaggccattacataatggtaaagggatcaattcaacaagaagagctgactatcctaaatatatatgcacccaatacaggagcacccagattcataaagcaagtccttagagacctacatagagacttagacacccacacaataataatgggagactttaacaccccaatgtcaacattagacagatcaacaagacacaaagttaacaaggatatccaggaattgaactcagctgtgcaccaagcagacctaatagacatctacaaaactctccgccccaaatcaacagaatatacattcttctcagcaccacaccgcacttactccaaaattgaccacatagttggaagtaaagcactcctcagcaaatgtaaaagaacagaaattataacaaactgtctctcagaccacagtgcaatcaaactagaactcagaattaggaaactcactcaaaaccgctcaactacatggaaactgaacaacctgctcctgaatgactactgggtacataacggaatgaaggcagaaataaagatattctttgaaaccaacaagaacaaagagacaacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggaaatagagacacaaaaaacccttcaaaaaatcaatgaatccaggagctgtttttttgaaaagatcaacaaaattgatagaccgctagcaagactaataaagaaaaaaagagagaagaatcaaatagacgcaataaaaaatgataaagaggatatcaccaccgatcccacagaaatacaaactaccatcagagaatactataaacacctctacgcaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagatggattcacagccgaattctaccagaggtacaaagaggagctggtaccattccttctgaaactattccaatcaatagaaaaagagggaatcctccctaactcattttatgaggccagcatcatcctgataccaaagcctggcagagacacaacaaaaaaagagaattttagaccaatatccctgatgaatatcaatgcaaaaatcctcaataaaatactggcaaaccgaatccagcaacacatcaaaaagcttatccaccatgatcaagtgggcttcatccctgggatgcaaggctggttcaacatatgcaaatcaataaacataatcctgcatataaacagaaccaatgacaaaaaccacatgattatctcaatagatgcagaaaaggcctttgacaaaattcaacagcccttcatgctaaaaactctcaataaattaggtattgatgggacgtatctcaaaataataagagctatatatgacaaaccccagccaatatcatactgcatgggcaaaaactggaagcattccctttgaaaactggcacgagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcatctcagcccaaaatctccttaagctgataaacaacttcagcaaagtctcaggatacaaaatcaatgtgcaaaaatcacaggcattcttatacaccaataacagacaaacagccaaatcatgagtgaactcccattcataattgcttcaaagagaataaaatacctaggaatccaacttacaagggatgtggaggacctcttcaaggagaactgcaaaccactgctcaacaaaataaaagaggatacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaggagcccgcatcgccaagtcaatcctaagccaaaagaacaaagctggaggcatcacactacctgacttcaagctatcctacaaggctacagtaaccaaaacagcatgatactggtaccaaaacagagatatagaccaatggaacagaacagagccctcagaaataatgccacacatctacaactatctgatctttgacaaacctgacaaaaacaagaaatggggaaaggattccctatttaataaatggtgctgggaaaactgactagccatatgtagaaagctgaaacgggaccccttccttacaccttatacaaaaattaattcaaaatggattaaagacttaaatgttaggcctaaaaccataaaaaccctagaagaaaacctaggcattaccattcaggacataggcatgggcaaggacttcatgtctaaaacaccaaaagcaatggcaacaaaagccaaaattcacaagtgggatctaattaaactaaagagcttctgcacagcaaaagaaactaccatcagagtgaacaggcaacccacaaaatgggagaaaattttttcaatctgctcacctaacaaagggctaatatccagaatctacaaggaactcaaacaaatttacaagaaaaaaacaaccccatcaaaaagtgggcgaaggatatgaacagacacttctcaaaagaagacatttatgcagtcaaaagacatgaaaaaatgctcatcatcactggccatcagagaaatgcaaatcaaaaccataatgagataccatctcacaccagttagaatggcgatcattaaagtcaggaaacaacaggtgctggagaggatgtggagaaataggaacacttttacactgttggtgggactgtaaactagttcaaccattgcagaagtcaatgtggcgattcctcaaggatctagaactagaaataccatttgacccagccatcccattactgggtatatacccaaaggattataaatcatgctgctataaagacacatgcacacgtatgtttattgcagcactattcacagtagcaaagacttcgaaccaagccaaatgtccaacaatgatagactggattaagaaaatgtggcacatatacaccatggaatactatgcagctataaaaaatgatgagttcatgtcctttgcagggacatggatgaagctggaaaccatcattctcagcaaaccctcgcaaggacaaaaaaccaaacaccgcatgttctcactcataagtgggaattgaacagtgagaacacttggacacaggagggggaacatcacaccccggggcctgttgtggggtagggggagcagggagggatagcattaggggacatacccaatgtaaatgatgagttaatggatgcagcacaccaacatggcacatgtatacatatgtaacaaacttgcacgttgtgcacatgtaccctagaacttaaagtataaaaaaaaaaaaatacagagacctgcttatttggactttgaacatgacgagttcatttagtctatgtaaatgattagtagaatgatctagacaccatcatgagtgattccagctttgtaggtagagtgggaagattccattgatttatgttcctatagactttattgaaagaagtcctaaaaagctatggggtggtcagttttccagaagtctgagtttaatgacctgtgttggaaaacatgcaaagctctgatctcattccttatcttgccttgccctttccttcatctattcaaaattataacaggtgccgctttctggggggaaaatagggatctttattgtgtgtttataacctgccttgtttccagaaagggcttcaggtaggacagaaatctttaaatttaggttttaaaggatgcaacaagaaatctacatcaatcaataattgaaaagcatcaaatatcactttgtttgaagcactaaacactgagcaggcttgaagggatattctcagataagtcactttagagacagaaagcagttatgttggctgacactgttcacagcagtctcagagtaaacaatattgaggacttgtcagctaatctcccttcaactttagttttagaggggagaaatgtctgtgtgctttgaagctctgaccttcttctgttctcagggaatttcctcagggagagagatgtttgaagagatctgtaacaggtatatttaatattctactagcttatactttggaaattatgtctaagattccttttaattgtgacatgaatattgagcagttttcattttcattcacttttcacatcatgaactaatgttcatacctccctgggaagctaatgtcagatttttaaacttccttttatgtgattaggttgcttttgtgaaaggtggaagaccaaagctcagttaactaggtcactggttactaccaggctagtttagcggctagcctgtggaacaagaactcaggtgggagctgacgcttttgtttccaatctcccaaggtatgaaaaaggtcagtccacaagagttaggttgcagatttacatagctgagaagtggggagatgtcttctgcatgcccctagaactaagattccttctttgtttcactaaaacttttttgtgtaaaatatcatacagtactaaaacccatatacaatttatttgttttaagagatgggatcttgctgtgttgcccaggctggagtgcagtggcatgatcatagttcactctaaacttgaactcctggactcaagcaatcctcctgtctcagcctcctgagtagctaggactacaggcttgcactaccatgcctggctaattttttttttttgagacgggggtctcactatgttacccaggctggtctcaaactcctatactcaagtaatcctcctgcctcagcctctcaaagtgttgggattacaggcatgagccattgtaccaagctacctggctaattaaaaaaaatttttttgtgtggagatagggtctcactgtgttgcccaggctggtctcaaactctgggcctcaagcaatcctcctgccttggcctcccaaagctctgatattatagatgtaagccactgtgcctggcctagaatttaaatcatgttcgaacaagtaaccatatgcagccactgaggttaagaaatagaacattaccaccattgtgaaagtcagtgtggtgattcctcagggatctagaactggaaataccatttgacccagccatcccattactgggtatatacccaaaggagtataaatcatgctactataaagacacatgcacacatatgtttattgcagcactattcacaatagcaaagacttggaaccaacccaaatgtccaacaatgatagactggattaagaaaatgtggcacatagacaccgtggaatactatgcagccataaaaaatgatgagttcatgtcctttgtagggacatggatgaagctgtaaatcatcattctcagtaaactatcgcaaggacaaaaaaccaaacaccacatgttctcactcataggtgggaattgaacagtgagaacacttggacacaggaaggggaacgtcacaacccggggcctgttgtggggtggggggagcggggagggatagcattaggagatatacctgatgtaaatgacgagttaatgggtgcagcacaccaacatggcacatgtatacatatgtaactaacctgcacgttgtgcacatgtaccctcaaacttaaagtataataataaaaaaataataataacattacccacaccccagaaaccatccttaaatgctctcttagacattatttttccaaattccccaaaggtcactactactatcctaacttctgctaaaatgattgattttgcctaattttatttttatgtaaataaaatcatacagaaaaaaaagtaaaaaagaaatagaacattaccatatttcagaggccccttgtagcctctgccctcttctgcagaggtaaccactatcctgtttttttatttgtttgtttgagacagagtttcgctcttgttgcccaggctggagtgcaatggcgtgatctcagctcaccacaacctctgcctcctggcttcaagcgattctcctgcctcagcctcctgagtagctgggattataggcatgcgccaccacgcccggtaattttgtatttgtagtggagatgggatttctccatgttggtcaggctggtctcatcgacctcgggtgacccgcctacctaggcctcccaaagtgctgggattataggcatcagccaccacgcccagctgcgttctgtattctataaagttcaaaattttccatatattgtttaccttgtctcattttgcaccttacagaatatggaatcacatgggatttccttctctgacttgcttcctccattcatcattgagtgttttttccatattgacataggtagctgttgttccataacttttaaagttttaccatattttattttatgaacgtaccataatttgccccttctaggttgatggcctcctgtattgccatcttttgaactgattaaattttcctgtttgtgtttctcattctctttcttctgtttgtttggaagctatgctgtattcttttagtagatctttagctgtcttaacatgcatacttagtctattatacaggctaaaattaaacagtatttttatcctgctcctaaacaaatacaaagacctcagaactctaaatcaggtaaaattcttcataatttatcgtattttcttgttgtttagtgttagctacttttccacctacaaattaggcattctagttgttttacatagtcaacaatttagctttactcacaacccacatagttgcctgatgtctttctttgctcattgttccttcttacacctcacacctatttttgtcaggaaatctttttcttcctcattcttgaaagataattatacaagttatagaattctaacttggcagttatttttgtctcagtgcatttgaaagtatcattcttctatcttactggtctccatggttgttgtcgatgttggcagtcaaaattgcagattgccattctttttttaaatttagctactttagctttaaaaattttttgtctttgtatacagcaacttcattatgatatgtctagctaaggttttctttttatttatccttgggtttggttgagattcttagatctaattactactctttcaacaaataatggaaaattatcagccattatctcataaaacattgggaatattgtctttcccattttatttcatctacttctaaaactctaattaaatgtgtgttagatccttagactctatcttccatgtcttttaaactgataattttcaactctgggttcctgggctgcattttagttatttatataacttcaattttattaattcttttttttagctgtttaatctatcattggattttgaatttcaattctcttacatttctagaaattcttgaacttttccagatctactgtgttctttatggcctacatagactcagacccaacccaaatgagagaatatgtggggctataaattgaaagggacatcttttcaccctccactcattgccaagattgagatactcaagttaatttgctgctccctctggacactgagttaatttcttgtccatcctcacattgaagggatggccttttaagatcccagctttacatgggtggtttcctgttagactttcaccttaaatgggccctttgctttgtctcccaccaccctgtacctagatgaaagcttgacaaaggatttgggtagatatttctccaaagatatacagacagccaataagcacatgaaaagttgctaaacatcattagtctttagagaaatacaatccaaaatcacaatgagataccatttcacacctataaggatgggtataattaaaaagacagtaacaagtattggcaagggtgtggagaaattggaacaaatgtgtgtgtgtgtgtgtgtgtgtgtgtgtgtgtacgtgcccaggctggtctcaaactcctgggctcaagtgatttgcccatctcagcctcctaaagtgctgggattacagatgtgagccactgtgcccagctaaaacatttttaaacatgttgctgagctggcatgaaaagaaagtatcccaagatatgtgtatgtatgtgtacacacacacacacacatatatatatacatacacacacatgctttctcaaggtcataaatgttcatcgcagcattattcataataggcaaaaggtagaaacaagtcaattgcccactaactgatgaatgaatggataaacagaatacccgtacaatggaaacttatttggcaataaaaagaaataaaatattgatacatgctatagtattgatgacccttgaaaacattatgctaagtgaaagaagtcagacacaaaaggccatgtattgtcaaattccatttatgggaaatgtccagaataggcacatgcatagaaacagcaagtaggtgagtgcgttagtgcgtgctgggagagggaggaatggagagctattgctgatagatatggagtttcttttggggatgataaaaatgttctgaaatcggatagttgtggtagttacatacctctttgaatagtctaaaaattactgaattctacactttaaacggtgaattttatgatgtatgcattatatcttgaagtggttttaaaaaaagctggaagcttaagagtcctcaaggtttaacaaactctcagggtggaaactggttttggcatttgatgactcccaggattcttgttttatttaatttttggcttcttgggatattttcttttcatgccagctcagcaacatgtttaaaaatgttttagctgggcacggtggctcacatctgtaatcccaacactttgggaggctgagataggcgaatcacttgagcctaggagtttgagaccagcctgggcaacatggcaagacccggtctctacaaaaattacagaaattagccaggcatggtggtgcatgcctgcggtcccagctacttgggaagctgaagtgggaggattgcttgagcccaggaggttaaggctgcagtgagtagtgatcatgccactgcactccagcctgggtgaccctgtctcaaaaaaaaaaaaaaatttcatgttttacccatacttgtttcatttgggaggatacccagtctgtcacagtgctagaaattgaagtcagaattcctttaattttttattttaaaaaagttcaaggcgctaagaaaagttgtaaggacagtatagtgaccttcctcatactttcactgtaatttctgaaatgtaaatatcctgcttcatccttcctccttcctgtctgtctgcttcatattttatggaaccaattgagagtaggttgcagacatcacactcctaaataccctagctattccagcatgcatctctaaaggacaaaagtattctcctgcataaccacagtgtaactatcattctcaaattttaccaaattgtcctaataatgttccttatattctttttccctgtccaagatagagcacaagatcacatattacatatagtcatcatgtcttctttagtgtcctttagtctagaatactcagtctttgtctttcatgaccttgacaattttgaagaatccaagtgagctgtttggggaatgctctgcaaattatgtgtgtgtggtgtttcctcatgagtagattcaggttatgtgttgttggcagaaatcccactgaagtgatgtttgtccttcttagtaccatacatcaaggggcttgggatgtcagtgtatattgtgattagtgaataaaactataatcacttttcttttttaaaagacagagtctcactcagtcgccctggcttgaatgcagtggtgcaatcatggctcactgcagcctcaacctcccaaggctcaagcagtcctcccacctcagcctcccaagtagctgggactacaggtgtgcaccaccacacctggctaacttgggtgtttggtttttttttttgtggagacagggttttgccatgttactcaggctggtctcgaactcctgagctcaagcagtctacccatcttggcctcccaaagtgctgcttttctgcaagctaaatgtgatctttttctgagcagaatgacacagaatttggagacaaacagacttggctttgagtcttggccctgctgctattagctctgtgatcttaagtgaaatatttaacatgttaaagcatctgtaaaatatgtctaataatacccacttcttaagattattgaaagaatcaaatgcaaattcatgtaaattgtttagcactggcgcattgtaagaactcataacccttgttctgggggagatgatagtatccaaatggcatgggggccgctctgtccctcaaaggtattggtgaaatcgctcagaatctgtgtgaggagcacaaaggccccccatgtacttccttttttttttttttttttttttggggacagagtcttgctgtgtcacccaggctggagtgtgatagtgtgaccacagctcactgcaacctccacctccagggctcaagcaattctcacgcctcagcctccagagtaactgggattacaggtgtgcatcaccatgcctggctaatttttgtatttttaggagagatggggtttcgctatgttggccaggctggtcttaaactcctggcctcaagtgatctgcctgactcagcctcccaaagtctgggatcacaggtgtgagttaccactcgtatgtacttcagttaattcccaaagagcccgtattctcttgcccttttctgccatctcacccacctcctttatcctttgctgtcatccatctctggtgtccgtaagaagctcactggtcccagtggtgggttggttttagatgttgaccaatgacgggtacagaggcttttagagaatgcagaccgacctcctattccattcttctccccttctgttttgtctcccttccctcctgggttactcgtcctcctcctctccaaatccttctccttctgttgttcagggaaactctctccagctcctacctccaaactgtgtatcttaattcagtgagggggtgcagagaaaagacttctcaccaaaccagaagcagctccctagagggcagtgggccttataaacaggaacttcttttcctgtaacatgattgtttttattctcattgtgcaacagcaatgccgtggatatttccttgatgtttattttgacttgagaggatagcaagtggtttgaacttgtatgagaaataccttcatgctggcactgcttggctggcaattagagtaattgcctgtggctagccatggacctttgcatgggtgctttatctgaatccagaggagaaagctgggctcagctgaaattgcgccacacaagatctttgttctttggaggggagtattagctggggccccaggcaatgctgatgccactttggttgttttcttgtaacccgtgtcgtcaatggttcccacaaaatgagctttggatgttgcaccttctgtgtcttcctttatgccacctcccactcctccttcatgaagctgtttgtctggatgaacttgtttggtgaggctgccagaccttccatatcaaactgagggatgcctttttcacctgctgttttcttgcttcatgattctaatatctagccctgtctcctgagaaattttttttttttgagatggggtctcactctgtcacccaggctagagtgcagcggcacaatcatagtgccctgcatccttgaacttggctcaaggaatcctcttgcctcgacctcccaataagctgggactacaggcacatcccaccatccccggctaagttactattttttttgtagagattggggtctcaccatgttgcccaggccagtcttgagctcctgggctcaagtaatcctcccacctcagccttccacgtagctggagctacaggtatgctccaacactcccagccctgagaaattatttagtcttgaaaaggagagaaagggagaagagaaaggaacagagtttaatcctgataaaggctactggtgtccagggaggccctacatggtgaggctgtgggcaagtaaggccccacggtggttgctgctgctgacttagaggttttgtctgtccattttccaaggattctccctttgtctttctttctttttttattttccttttttttttctttttttgttgagacagagtctcactatgttacccaggctagactcaaactcctgggctcaggtgatcctcctgcctcaacctcccaagtagctggtattacaggtgtgtgccaccacatctggcttattctccagggagtgggactgcatttgagggtgatgagagtttgcgggaactgtgttgtgttgtccaaactcaaaggactctattacccgaagttatgttacttgttccaatgaagtctttattttggagaggcctgtggaccagaaatgatactgggccccagaccagttgtgttggcctatacagtgttgaaaatcagaattagttgccagtaagtaaatatcagatattataagaaaatctagatttccatgatctcttggaaaattggacaaatgcacaatactgagcccatagttcctcatggcagtaatcctttggagccaagaagtggctgccctctgcatgtaagagtgttggtcaagatgcatgtttgactgttgtgacaaagaccaaaacaagtggcttaaacaaggtggaaacttgtttttctgtcatgacagtcaaagcactaattgcccagggcagacatgatagctccgtggtgtcagagacgctgcccacttctgtcggttttccctgttctctgcagtgggttccatcttctgatccaagatactgcttcatttcccaccatcctgtctgctccagccttcagtaggatggagaagtagaggatccctttcttcaagatccaacctggaagttacatgtatcatttcctctggcatcctgttggtcagaatgtacagcatggccacatctgactgcagatgaagctggggaaatgtggtcctcatctacgtggccatgtgaatagttaaaacccacttcttactaaaggcagaatgtgagagcggatggtatggacaaactatattctgtgctgtgaggggccttgcagtcacctatttgctgctattctcagctctctccagtcttcccgtaattgaggtcaagagtcattgtcatttattttcttgtaactgatgtgtttcactcatttatgttacctgcttggtccctgtaggcatttgagtttgcattctcagctgtgccctgatcatctctttcaacacacctccatgcttttatatttgttgccgcctctgtttagaattacctggcctccctttcaggcctggcaaactccttctcaggataacgcagccccatgcttcccttcccaaattgagttatctctgttaaccatcctaatatataagctgccaattttacataataccttttagtttacttacctttatatacttgatgcccagaacagcactgggtacataacagactaagggtcagtcctgtttactgagtgttcattcagtgaaagacacttcctagaacttaaaagcatttttaatatctaacagtgaaatagtgtattagtcacagcctgtacagctgtagatgatggaaacgtggctaaattggcttccatgacaacaaaaaggaggagcacttactggctcgtgtatctgacaagctgagctatgtgtcaagcctcaggtatggctggaaccaggagttcaatagatagcaggactcagtctctcttctcagtgtcttggctgtgctttcttctgaataagcttcattcttagaaagagtttctctgcatgatgatgacaaagatgccacccacggttctgtatttttcttataattagtgatttttttttttaattttttttttattatactttaagttttagggtacatgtgcacattgtgcaggttagttacatatgtatacatgtgccatgctggtgcgctgcacccaccaacgtgtcatctatcattaggtatatctcccactgctatccctcccccctcccccgaccccaccaccgtccccagagtgtgatattccccttcctgtgtccttgtgatctcattgttcaattcccacctatgagtgagaatatgcggtgtttggttttttgttcttgcgatagtttactgagaatgatggtttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgcttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttattaataatgggagactttaacaccccactgtcaatataattagtgatttttttaagaaaccataaatctattgcttcatagtggtaaccaagcacttcgtagtggccaccaatcaggaggaagtccctgattgacctagctcaggtcacatggccattctcagtccagtcaatgtggccaggcataagtgaggggggagaatagggtctggaagcagggaacctaaggctgattcacgctgatttcctagaatggaattaaaaggaaaaccccaactttccatgcccaagtaacaaaaggatcataagctacttcctttgcacccccacccactttttcttcgtggcagatggaaaatggaaagtactctgattggtccccttctgcaaccaatcagactggtcgtgggcctagtctttatttgcataggggtataactttgtaacttcacttcagcctttgattggttgccttctgcaatcaatcagactggtcatgggccacttctttatttacataggctgtaaccaagtaaccagtgagaaacctctagaaggtatttaaaccccagaaaattccataaccagcatgcttgagcccactcccatactgtggagtgtgctttcgtttcaaaaatctgtagtttcattgcttcatttgtgtgttttgtccaattctttgctcaaagtgccaagaacctggatgactcacagtcaagacccgtcactggtaacataagtagtctggccatacctgggtcatctgtctacttctggtacctggggtggagtcgaccctactcaaattacattgaaggaaaggtaggtctccaacacgagagaaaataggcaaaaaaaaaaaaaaaaaaaaaaaagtgacaattatatttggaactacctttgtctcattttataaataaagcagctgagggtgagagagattatcgtgacctaaggtcacaaccaggaggcggcagaagtgggattcacaccagatcttcctgactctaaatggtagactgttaattcagtgcacccaactatttctgaagggagttatcctggaactccccaagccccatctctgcatggggacaatcctgaggtttgatgctcctgtgtatgactattagtatgtagagataccttgtaggcccaccatggcaggattttgtgtaggagcacatgtttagctgtaagctctgttttccctggcacctctctagtggctacactgtacctgaaaatatttctcttacccatcaaaagaactctttacattaataaaagttggaagagtcaggcagctggattcgtctcttctcttggaacgttttgattaatttagcacatgcattctcatcaaggggtggtgttgcttgcaagggagcaaaaactggttcttgggggtagggagggaaatcttaccttttttaaatgaataaagtacatatatacatgtagtatctaaatagacagtttatctgagatgttaaaatttcctggagataatatgctgtgatgaatgccatcttgaaaactgtaacatatcttccctccagaagatatgtccctcattcttcaacagttgtcaccttttttctctgctccaccttgcagcaaaacttcttgaatgagttgtctttatttcctaattcctctcatcccacctgctcctgactgaaccctctccaatcagccttgtcactagtctacccaaacagctcttaccaagggcaccagtgacgtctgttttgccaagccaaatggtcaactttcagtgcttatcatactgagcctgaaggccacattgacacagttgacccctcccctcaatcctttaaatatcttattttcttggcttcaaaggtcactgtcctaatttttttttcttatctcactggatgtgtacctcatcttctttcctggtgcctccttatctccccaactgtaaatacaagagtgccagggctcaggccttagaacattcctcttttccgtctacactcattccctcagaatcatggctttcaactctctctataggtcctcatttctagccccagcctagacttctcccctggatcccagatttgtatctgcccactcaccatctcttctgatatgtctcataggcaactcaggctaagtatcagttttgggttaatacagagaacagagaaacatattaaaagaacccatgaggacacagtcagcaaaatctagattgtgtgtacgggacaaatgacccagttttttcaaaaaataaattttaaagaaaaaggaatagaggagatgcctatagattaaaagagatttatgagataaaagtcagttgcaatatatgtaccatatttggatattgatccaagcaaccataaaataattatgagatgatcagggttatttgaatattgactggatattggatattatcattaattatttttagctatgagaatggtgatttggcgatattagaaaaaaattaaaaaaatatatacccagaatgttatcaattcttaccacctgcagtattatcaccctcagccaaactaacatcctctcttgtattatttttatattgcctcttagctgatttccctgcctataaccgaccccctacaccggtctgctctcagcacaacagccagagatatcctggtaagatgtgtcatgatattccacttcccattgcatttggagtgagagagccagtctgttcagtttcagtctgcaagaccccatgggttcctcccttacctctctgaccttatatcctgcgctccactcctgggtgagctgctctggcccccttgctgcttttgtgacacagcaagcatgctccagctctaggtgtttgtattttctcttctccctgcctagaacccactttctccaggtcttatttcagcacctcctttccctgaacattctgtgtaataagttaacccttatctccttagcctgcctagtatttttccatagcatttgttaccatctgatgtatgtactgtttttttggtctgatgcttccactagaacatgagttatgtgagagtagaaactgtatttttcattgctgtatccctagtacttaaattgcacataacacgcactaaataaatgttgaaagaaaaatagtttttcatacagggggaggaaatgtttataaatgcttagggggagcatgataatgaaaaaagttgagaatccctgctttagccttgggaagcatgtggtcatcttgtccctgctattactgttgttactgtatttacatttctctgtcttttccaccttgggatagtccgttttatcatgttataacgtgtcatacagcaaaactttgtgaattggctccaattgggggaagagtcatttgagtttcttctcttcagactgagcgcttgctatctggcttctgtgctgcagtcggggagctcacatcgcaggcgcatgtaatgtgaccagcacgtcccccgggagttagcttccttccccatgcatgagctggagcctgcggaacaggatggcgacagtttactgaggtgccattgatcccgggacacgtctaggcatttcaggccgggcagttgaccgtcatatgggtctctcctacatagcaggatgtttactgtgtctgcctttcaggatttatcttgacacaaaaaacaacttgttttttacatgcacacatacatcccctcccctctgtcccaccctccacacttggagaactaagatgtcaggaaggccccgaggaggaataagcaagaaatgaggcaatccaggcaggcactcagatgtgctcgtagtttatggccagaaaacagtgctctaggtgtgttcagatgactgtggtatcttttctgaaactccatttgtaaatatttatagcccacttctttccaaaaaggatttgaaatagctttatgagtatacataaacccacacacaaatatacacttagggctgggcacagtgcctcacgcctgtaattccagcactttgggggagccgaggtgggcggatcacctgaggtcaggagttcgagaccagcctggccaacatggtgaaaccctgtctctactaaaagtacaaaaaatcagctgggtgtggtggcacatgcctgtagtcccagctacttgggaggctgaggcatgagaatcatttgagcccgggaggcagaggtttcagtgagcagagattgtgccactgcactccagcctgggcaacagagcgagactccgtctcaaaaataaacaacaataacaaaaaaatatatacacttagatttaacaaaacaagagtggaaaacaagaaacctggcctgaaagaacaggaggaagcagtgagggagtcttgagagttaagtcgggatctgcgaggggaatcacatgcagctggatgccctctgccagcccagtgcccagggaagcggagtggggctgcctcaccttgtcctcaccttctaccagcctttgcattatatctcataatttttcccctttagtcatcacattgggttatctattgaaaaatccgagtagccaactatatagtatcatttaaaagtggacataggactttgagtagacattctaggtgattggtgcctgtctccagcaccgacctgtgatcacagctcacagagggcatgaactgtgtctgttcatctttgtactccagtacctggaagccaggaggaactcaataaatattttactgtataaatgaatggctttacagttcttcttacaagaaaggaagaagcctgtcagttgtttgagggaaaggtttttgtttttgttttttcctggttctattttgagagttctctcatgtgggcgattatattaggaattttgagtggtgtcctcggtcttgttctcaagaaaattgggagaaatgcagacgcaggattcatgtggctttccttgtaagggggaaaactgaagtcctgactttgatgagcagtttaatgcagagtctgagaggccccagcgaaggtgatcaaggtacacaccttttcctcatatgacctggttcaagagcaaatggaaattcctcagggagggtagagaacagtccctaaatgttactgctttcagggccactttgggtacatgctagaggtggttcaatttgggattatgtaatatagtagtaaaaagcagggaccttgcatagaattatacacaaaaatataccacaaaaaataatagtggtgcagtggctgggtgcagtggctcacgcccgtaatctcagcactttgggaggccgaggcggatggatcacttgaggccaggagtttgagaccagcctgggcaacatggtgaaaccccatctctactaaaaatacaaaaatcaactgggcgtgttggcacacacgtgtaatttaagctactcagaaggctgacacatgaaaattgcttgaacctggaaggcaggttgtggtgagccaagatgacgccactacactccagcctgggtgacagagcgagattctatctcaaaaaaaaaaaaaattaaattaataataatactagtagtacacgtaaaaatgggtgaaatctatgtgaagtgtattgcgctcattttggtttcctggttgtgataaagtactgtagttacataaggtgccactaattagataaattgggtgatggatgtataacacctctctgcactgtttatgagtctataattaaaaagcagggccttggcaacagagttgtgttgaatcccccattaccccagctgagaggtgacttttttctcctggcatttaacgtaattcttaactacctatttgctctgtgcctttctcccccaggagaaagcagaagctgagtctgttttgttcactgctaaattctctgtctcctagcacagtgtgtggcacctgtgttttgaagtcagatgtttggatgaaagaatagttatggacacaggtgacttaaattctctcaggcggtctgcagttaggtcaatacctccctgtcaggacgatgggagaattaaatgtgtataatgtagctaaagctcagggccttctgcaagcaaacactcaacttccggaggcggcagactttttccgtcaagggtcagatagtagtggcttgggctttgcagagcatgcagtctctgttgtagcggcccacctctgccactgtagcacaaacgcagccagagacaatcggtacatgaatgagtgtggtgcatttaaaaatgcaacttaaaatcttttaaattgcaaattaaaaataatttttttatgaacctgaaatttgaattctttccaaccatttcaatatataaaaatctctcttagcttataggtggtgggctagatgtggcctcaggtccacagtttgtgcactgtgatgggcactgtcacttttggcaagctccttctccacactgctggccgctggggtaaacgaagaagctgtggaaactatataatttggtggcaaagttaatgttccccacaaaaccagatctgtgcaatgagtttctctctgggctgggaggaaggctgctcctgtggcccagataaacccagcctgcattttgcatgggaggctttgtaggattggcaccatttcccataggaaggcgtaacacacatgttctcagctctaggcagcttgctgtagagcagggctgtccaatcttttggctcccctgggccacactgaaagaagaagaattgtcttgggccacatataaaatacactaacactaacggtagctgatgagctgaaaaaaaagggcgcaaaaaaactcatgttttaagaaagcttacaaatttgtgttgggctgcattcgaagccatcttgggctgtatgcagcccgagggccgcaggttggacaagcttgctgtagcgtgttgtccaggtgcacttgtctgccggaaagggcagatagatgtgggctccagccctgcctgatagcctctcggctctgagcgtgggcagatctctcaaggccctctgaaacttggtttcttctgctttaaaggtggaatggtgaggtgcagtggcagcctatttgtggctgctttgcttaatttggggttagctaatagctgttcctttttttgtctaaagtggttatactgacccaatccattacaaagttgctttgaggactaaaatgaaacaatttaaggtgtctggcacttacccatcatttttattgggcaccttcttaataatgtttgaatctacataaggtaagatcatctacattctttcagacacacagccatttactcctctgaatttgaagtttttcttcaattttttgtcttcataagaattaaaatgttacagagtcataaattttgttttccaagttttacctaaaaccctcagatattttgctcctaaacaggttaaggaccaatgtgatactgccctcactcttaaaatcttgaaatccttcagctgttaataccattaaactattactaactgatttatttttgtagtgttcaaataaattttaatataggttgggtgaaatctagaaaagttgtatattttgtctttatgtataataggaattacaaggaagtgccaattcagagtaaagttaaatgaaaacatgagagttagggaaataaggctttattagaatacacaaatgccttctgtggtcgattagattgtgagaatccaaataaatattttagaaaattattatttgaataaaagtgcacattattttatgtgtccgccattatttaatgtattccctcaaccatatggagatggcagaagagatattgattcaggctttggttgtgagtgaaggagataggaaaattatctggaggctgctggtaggattataaggaaaaccactaaagaatctggaaatatgttcatatgccagctgcccctcacaagacagtattccgtgcttgaagtttggcaagagagagatgatccgtttatggctttaaaaaaaaagtatttacaaaatcttaattcacacgatacattatatttatttgacatgttttattacggatcataaaactaaagttctggaagattaagtcactttccagatatcaaataggtagacctggaatctgaacacagttggcctgacttgcaatccatggtcttttgacaacatctttgtttctctgtgttcaggactctgctaacacaggattttagatgatgggtccttgctctcaaggagcttacaacttaattgaggagctgactttcatatatgagagtaagtagaagaaaatacagctatcatttctttattttttagagacagggacttactctgtcactcagggtagagttcagtgacatgatcgcccaccgtaaccttgaactgctgaactcaagtgatcctcccacctcagcctcccaagtagctggcactacaggcacccaccacacccagctaattttttaaaaacttttttgtagagatgggggtctcactgtgttgagtaggctatacagctatcattttttttttgaaatggagtcttgctctatcacccaggctgcagtgcagtggcacaatctcagctcactgcaacctccaccttcctggttcaaacaactcccctgcctcagcctcctgagtagctaggactacaggcgcccaccaccacgcccagctaattttttgtatttttagtagagacggcatttcaccatgttagccaggatgttctcgatctcctgacctcgtgatatgcccgccttggcctcccaaagtgctgggattacaggcgtgagccactatatctggccgcagctgtcatttctaaagcaccttttggtttccagtgagctatctcagtcgaatttcctataactatgaattagttgaggtacatgccattagctcattttcatggtgaggaaaccatgaaaaggctcaaaaagttagtgacttgcctaagattataccagtaagtgacaaagccaccatgtggtactttgtgtcttgcagtttcttttttaccggaagtcacaaaatcagctgcatacaggggccaggaaggcagaatatatgagcaaagcacgttataaggcaacagggagcagtgggtttgtgatgaaccagagattgaaacttctgtctgaagaggtcactgctacttggctacagctgattgtgcccataaagaagtgaaagccccaacgataacggatctaatttttcagagatgccctaaatctgaattttaatttaaaatctcctgattaaccttctctttaaaaattctcagaacactgaattaaccaacactatgtgtgctaaacaaaactgtcttttgggcctcaagtttgagaatgaactctgctgtatactctatggcctctaagacaaactctgatgacttttccccaaatgagtaggaaatcaggaagcttcagagagccatggtgtcaaagaaggcttcctggaggaggtgggatcagaaaggagccttgaaggatggatagtagaaaagaagggagagatccttccaggctaggagaggggagagaatatacagtaagtattgagcacaatacctgaaatattacctgaggtaataatattagcagtgatgccagtatgctagtatattaacaagaaagccagtctaactgaaatagatgcatagaaaatgtgggaccagccacccaaacctccagcaaataccatacttagtgatgaaacattagaagctttcttttataaaatcaggaacataaggatcttattaccatttatattcatcgtaggccctggaggccctaaccagtgtagtaagacaagaataagaaatacaaggatgggggaaaaaggaggccagtcatgatggtgcacacctgtaatcccagcactttaggaggccgaggccggtagattgctcgagcttagaagttcaaggtcagcctgggcaacatggtgaaaccccatctctacaaaatatacaaaaattagccaggtgtagtggtgcacacctgtagccccagctacttgggaggatcacatgagcctggtcaaggctgtagtgagctgagattgtgccattgtactgcagcctggatgacagagtgagaccctgtctcaaaaaaaagaaaagaaaagaaaaacaaacagtcattattcataatcatattatctacgacaaaaatccaagagaatttacaaaatagtgttcagcatgattgcttaatataagtcataatacaaaagtcaattccacttctgtacacaaacaataaacagtttgcaaatatttctaaaactttatatattacctttatggagcaaacctagaaacttcattgaaagataaagatctaaataaatgggaagctgtaccattttcatgaatgggaagcatcagtattgtaagatgtcagttcctaaataaacacattcaatgtaattataattcaaatcacaattttgtatgagtatggataatgtacatgtatattaagctgcttctaaaatgtgttatatgtgaaacaggtagtccaaggccagctttggaggactttggtgctggaacatggagtttagacctgatccaacctgctgctgtttctcaggctagggccggtgtttgtattttcaagtattaaaaacaaatttttctgttattttaacaatacaagcaaattctggaatttaaaatttgcccaagggcttctgggtgatttcaggctagacacttgtgtttgtgtttgcagtcacatttatactgagttacaatcatttgtcatgggctaatgacagaggaacaaggcagactgattatataagcatctggttagaccaagtgcaggccaactaatctcacagcccagcaaaggcttgtagcagctagtgtgaaatggtcgaagaattacgaggctggctcatttttgtattttttcaagacacggggttttgccatgttgcccaggctggtcttgaactctgaatcccaagtgatccacccacctcagcctcccacagtgctgggattacaggcgtgaaccgctgtgcctggccaattttattttcaagattttaccactagcaatatgtaggataaatgggagatgagaggcaaaggtgagtttgagtagagaagaaattttttttttttttaatacagagtctcgttctctctctcagtctggagtgcagtggcacaatcttggctcactgcaagctctgccccccgggttcacgccattctcctgcctcagcctcctgagtagctgggactacaggtgcccgccaccacatctggctaatttttttgttgttgttgtatttttttagtagagacagggtttcaccgtgttagccgggatggtctcgatctcctgacctcgtgatccgcccgcctcggcctcccaaagtgctgggattacaggcgtgagccaccgtgcccagccgagaagaaaatttattgaaggtcaattgttgacaagtcattaggcacttactcccctcaaaacaaccccatgagataatttctcccttatataaatgaggaagttgagccttagaaatgttaagtaacttatccaaagctacatagctagaaagtgaagcaggtaggttgtcagtttagactgcattctaccaagctttaatacagggatgagtagtagccactttggcatggccacaggggaatccagaaaaaagaatgaatctggaaaccttatttttgaattgcctttttcccactagaaaacctgagatacccagcacctgcctagtgtatggtctgttaagcctatgatctaggtactgtatggctgggtcccaagccctgcctccttaaacctagttcctagaatgtatgattagagggggagtcctttcctgccactctgtataactagttgtgactagtttcatggcctgtattactgttgttttttgttacttggtgattgcatataggatgtaaatattttcttggaagttgaaaaaataaattaggtgagactatatctacttgaactcttcctacagatctatagctctcatcaccttctatccggatcaaccttgtggtttgagttttaacaacctggcctggaaacagaatgttttgtgtttcaaggagagattattggagaaaatgttcagaagaatccaggtattcatgagcttgagtttgcgtgtggtagaaatgtctgcctcccacattcaatccacgccaccttggattgtccccaccttcatcatgcagggcagtttgaaatcagaggagattgcgaaattggagatttcaaagggaccttgagctcctctcgtatagatgcctcacagataagacaggggccaagagacaaggacactttgtgagtttctggaaacccagctgagtcttgatctgaagcctctcctgtttcccatatgttgcaactttgtgtttctcttttctcaattaaattcaattttcaaataggcatagactgcgtaatccatctacatggttcaaaagtatgaaaagctgtgcacagaaatcttgctctcccccgccttcctgccattaaccctaccactgacacatgacaattttagggttcttatttctctttctttggataaacaaaggatactgtttatcctttaggcccggatttctcaacctgggcactgttgacattttgggctggataattctctgctgcaggggactgttgtgtgcattgtgggatgcttagcagcattcctgacctctacctactagatgccagtagtagcaacccactgacctgagtcatggtgatcaaaaatgtctccagatgttgccaaatgctctgtgaagggcaaaatcacctgtagttgaaaaccactgctttatgcaaatagaggcaaatgcgaacgtgcattttgattttcacccttttccttgagcaatctatacacatagcttctcttcctgacatgcatatatcctgatagacatatatccatatcctaatagatagatatatatccatgtcctgatagacgtctatccatatcctgatacatgtgtcccagaatatatgatgtgtgtatatatgtgtgtgtatatatatatatatatatatttaacttttacatgtatagatatcctagagatctctgaatcagtggaggctgccctcactttggcggctatgtagcagtccatggtgtggaggtgccatcattgattgaacttgtccactgtggttaattgggtacttgtttccaatctgtagctattaaactgtgctcaggccaggcgtggtggctcatgcctgtaatccccacacttggggaggctgaggtgggcagatcacttgaggtcaggagtttgagaccaacctggccaacatggcgaaaccccatctctactaaaagtacaaaaattagccaggcatggtgcccacctgtaatcccagctacttggaaggctgagatgggagaattgcttgaatccgggaggcggaggttgcagtgagccaagattgtgccactgcattccagcctgggcaacagagtgagtgagactctgtctcaagaaataaataggccaggtgcagtgactcacatctgtaatcccagcactttgggaggccaaggcaggtggatcacctgaggtcaggagttcaagaccagcttgggcaacatggagaaacctcgtctctactaaaaatacaaaaattagccaggtgtagtggcacacacctgtagtcccagctactcgggaggctgaggcagaagaatcacttgaaccaggaggtagaggttgctgtgagctgatattgtgccactgcactctagcctgggtgacagagggagactctgcctcaataaataaacaaactgtgctctgtgagtaagcctgttcatgtgtcattcttctttgtgcaggtgtatctgttgtgcaggtgtattggttgtgcaggtgtatctgtaggttagatcccagaactggggttgcaggatcaagggtaaatacatctcattttggtggccacctccagatttctcctccatgagagtcgtgccctttggtactcttatcagcagtgacttgagaggccagtttctccacagcctcaccaacaggattgtgaaacgtttgaattcttgcctatcccataggtgagaagtgcctcatgtttcttaacctgagtaacattgatccagccttacatatcgtgaacaaggagctaagtgaactcagcctagtctgcttttccctgaatggcaagtgtcctgtgcacatctgtgtccaggtctttgtgcttgctgtccctctgtcaggaatgctcttccatttcactttagacattttcacatcctgtgaggcttccagatgccttcttctctatgaaacgttttccgattatgctttacgctgcatttttgtccttctccacgttccctctggcttagtgctgctgccttgtgtggctgccagtcacatagctgttgcccagagccaggtgggagtctgcagtcaggcaggtctggttttgaattccagccttaccacttactatctctggatccttggtcaaatttcttcttggagcctcagttttctcatctataaaatgggaatgatacttctctaggagaagccacataaagtatgcggcagcagataggcatttaataaacatcagctcctcgagggcagatccgtcttcttgttttctgccctgccttccatgtgcccttgcatgcagtgaataaagatattgtgtctattctttaaaacacaaaactgtggccagatgcggtggctcacacctgtaatcccagcactttgggaggccgaggcgagcggatcactcaaggccaggaatttgagaccagccaggccaacatggtgaaaccccatctctactaaaactacaaaaattagctgggtgtggtggtgcacacctataatcccagctacttgggaggttgaggcaggagaatctcttgagcttgggaggcggaggttgtagtgagctgatatcatgccactgcaatccagcctgggtgacagagcaagactctgtctcaaaaaataaaacaaaatgaaacaaaacaacaaactttataggaagtgaatggtgatttattcagcaattatttgaacacatattttgttccaggcatagatctcaaaactgaggatttaggctgggcacggtagctcatgcctgtaatcccagccctttgggaggccaaggcaagtggatcacctgaggtcaggagttcgagaacagcctgagcaatgtggtgaaaccccatctctgttaaaaatacaaaaattagctgggcataatgtcgtgcacctgtagtctcagctactcgggaggctgagacaggagaattgtttgaatccaggaggcggaggttgcagtaagccaagattgcaacactgtgttccagcctgggcaataaagcgagactccatctcaaaaaaaaaaaaaaaaaaaaaaacaaaacaaaacagcggaaagagaaaatccctgtctttgtggagcttgcattcaattagggtgatagacacccaatgaatagaagtaaatgattcagtagtaagcatagatccaactattgtatatcattttgttaagttgaggaactgtaagttccttgggggcaggaaggatgactgcccttcatggaacctcttcagagcctagtatgatggaggaaacccatacccacatctattaatgtctcccctctgcttaaacccctagcagctcctcatggcctccgggctatggttcagactcctttcctggactgcaaggccctgtgtgatccggggcctgcctttctatctggctttgtttgttgcctggatatctatccaccctacgttccagctccactggacctccagttcctaaaatgttccatgctgtctcatctctgctttattctacctgttattccacttgcctgtaatggtttccatgcccacctcacctggctaatatctatatatcctttaaatccttttgttctgtcttggatgtcactgtcttcaggaaaccatccttgattttcccacctctcagtctgtgttgtgtgcccctccagctctgtgctcagtaacaatcaggacttctttgcttcagccttttattttttatttttttttaaataaagatgaggtctcactatgttgcccaggctggtcttgaattcctgagctcaagtgatcctcccacctcggcctcccaaagtgctgggattacaggcatgagctaccacacctgacccagacttctacagcattatagggtaattgctggtttacttgtctgaatctccctaattgttcagccccctccggagtaggcttgtctctcccatctggtggtatgtatctgcaatgagtacctggcacaatgagttatggctagacagatggatagttgaagcgtagaataggaagtggatacatgttctgacttggctctcctcactggggccagcccagtcggaacctgttttcctttgtaggaatcttgtttccctttgccactcccttgaggcaagcaacaggtcctgcttctggtccatcacaggtctgatgaccctggaatgatcacttaccattctggggcatttattaaatgacccactggggctgcaggattgcttaagtgcaagagctctgttgatgtattccacaggaatggcaccccttagggttgtgtaatgtgcccatgttgcattagatgttccatccagatctgaggttccatgggtgggggcctcctgcctctctcacccaggttttcctcgggaagagcagtgcctaattaaaaccacaaagggaaaaaccagggcggcagactgtgtgttattgtggctgatgatgcttgacatggccagtagagggcagcagagccgtccaccatgacctccacattttcgttattgtaaataagggatcctgaggatgccttctccactccctccccgtgtgtttgctctcataggatggttgtttttctggaaggtttgtggtctagccattgaacagagagaaaaacatccccttaggatgtgttgatgcaaaaagatgattttagaaaaattgccctctgggttcaaagaaagattacatcatttcctcaccttgaatgtacacagtctagggatatctaaactttatttttttaatttatttatttttgagatggagtttcactcttgttgcccaggctggagtgcagtggtacaatctcggctcactgcaacctccacctcctgggttcaagtgattctcctgcctcagcctcccaagtagctgggattacaggcgcccgccactgcacccagctaatttttgcattttttagtagaggtggggtttcaccatgttagccaggttggtctccaactcctgacctcaggtgatccacccacctatgcctcccgaagtgttgggattacaggcgtgagccaccgtgcctggcctgtacctaaacttttgatgaggctattcttatctgtgaaccaacatttgtgactaaagctcaccttggggaatacagtggtaaccttgcacagagaatgctgtggctagcagcagccccgtctggggtggcgcagacactccaggctgctttgtctgtctgaaatcccagcagtgtcatcacagcatcttgtgcaaaacattgatggtgaaagataacaatttcttctattgctcaccagcctcatttggaaagttaattaccagcttgtggaagttaaggaaagacaagttcttaaactcagggggatttggcattttaaaatacaggtctgtgggtgggaaaataaggtttgtgtgtgggaaggatttgggaaaatggactgagtgttaatttaaggacttgaagtgtttatgagggaaccctggataagaataacattttaaaaattggagatgatgagaaactcaagcaccaaggtaaagaagtctggcttgtgttcttcaactggtttcatggtcatcagcagcagccattgctcagaactccaacaaaagctctctaatctcttaactaaaaactttttttttttttttggttgggggtggggggcagtggctggagtctcgttctgtcgctgaggctggagtgcagtggcacaatctgggctcactgcaacctctgcctcccaggttcaagcaattctatctcagcctccccagtagctgggactacaggctcccaccaccatgcccagctaatttttgcatttttggtagagacaggttttgccatgttggccaggctggtctcaaactcctgatctcaagcaatccacccgcattggcctccctaagtgctgggattacaggcgtgagccatcacgtccagcccctaattaaaaactctatataaatatttgaggatctaaaatacagagatactataaacatacccccctttttttttttttttttttactttctgaaatctttcattctctttaaaaaatttcagaatgagcactcttggtctctttccagggcgatccttgctagatatttttcttatatccagcttctgctaattaaattgaaacaatcctgacttcatatttcacttgctctcctatcattcggctccttatcagattgctgctttttaaaaaaaattttgagacagggtttcactctgtcacccaggctggagtgcagtggtgcgatctcagctcactgcagccttctcctgagctccagcaatcctcccacctcagcttcccaagcagctgggactaggggcatgcgccaccacacccagctaatatatatatatatatacacgtgtgtatgtgtatatatatgtgtgtgtgtatatacacacacacatatatatacacacacatacatatatatacacacatacacacacacacacatacacacacacatatatatatatatatgtatatatatatatatttttttttttttagagacaggggtccaggctatgttgcccaagccgctcttggacttctgggctcaaatgatcctcccacctcagcctcccaaacagttgggattatagacacgaaacactgtgccccgctcagattgctgcttcaaatccctcttgggatcacacctcaaagagtcctgacgtattttcatagaaaacagcccatgggcctagagcctgtattatcatacagtgtaaggtgagaaaatttcaaggcacgatttccaaatgttaatttttcttccttctactccttccttttggagaagaatttaaaagggaccattggtttgaatcaatgaaaatattggcttaggttactctgtattttgtaaacttgttgaagtacttggtttaaccattgaaatgccaagattctatttagctcaactgtctctacaccagagatcaactttccttttataggagtcattgattcaagaggaaaatataatctggtattaggtcatttttaagaaaaataattttttaatttttgtggctacatagtaggtgcttatgtacctggggtacatgagatgttttgatgcaggcatgcagtgcgtaataatcacatcttggaaaatgaggtatctattccctcatgcatttatcctttgagttacaaatgattcagttatactcttctttatttttaaatttataattaaattatcattgacggtagtcttcaagaaaaatgtacttgaaacttagaaaaaagttcaggaagatgactgagtgcccttttaatatcctactagaacattgtctgacaaacccagcaaagatcatctaataatctaggggaaaatgtagcaatgtttttctgcagactgccagatagtaaatattttgggctttgtaggccaaaatatgtactgtctgtagctacttaactctgccatcatagtgtgaaagcagccacgggtaatacataactgaatggatacagccactgtaggtgctgaaaagggatgatgcctttcttctccatcataaaaatcatggccagcacctctataacaaaaaggttaacagacaaaagcataacacatttctttgatcatacttttgcgtgacacagcagtcttcagatcgaagacccaaagatacaggggaagctatccatttttatgcttcagtttgatgatgaatggatagctgtgtggaactgtggttggaccaaaagggtgtgatctaatgctaataggctgagcgggggaacccagcaagggctgtctgttcagattcttcttggactctctgcagcataatttccttccaggtatggggcaggaccctttctggaatgggggtcttatgaactacaaccaaacaaggtcagtcagattatttctttgtggccaattcttacacagaaaagtaggggaaatttttagattttatggctggctttggggaaaagggttttggtttccatgatctccattggggaagagggattctaatatctgtgcttgcctttttgggggaaagggggaatgaggctgagaggcaagcaggacaaggtcagagaaaaactgcttctgagcccttactttagggtattgtcttctgagccctaacactgttccaataaaactttatttagagacactgaaatttggatttcatagcattttcatatttcattttatgttataaaatattcttttaggctgggcacggtggttcacgcctgtaatcccagcactttgggaggctgaggtgggtggatcacctgaggtcgggagttcaagaccagcctgaccaacatggagaaaccccatctctactaaaaatacaaaaaattagctgggcgtggtggcacatgcctgtaatcccatttacttgggaggctgaggcaggagaattgcttgaacctgggaggcggaggttgtggtgagccgagattttgccattgcattctagcctgggcaacaagagtgaaactccatctcaaaaaaaaaaaaaaatcttttaatttttttcaaccatttaaaaatataaaaatcatccttcacttgcaggtcttataaaaacaaatggctgagattaataaattgcaaatgatttttgtccagttaagatgggaaggatttcttatggcagaaaaggagcatcaggggtactgctatatgccaggtaggacattaacccggtttgtttctaagtttccagccttatcccggcattcatctttccacagattttttgccctacttaggtttctgtgccatccacctttgagccagctttgtcattctgcttaagttgacaaactcatcaagttacagaatctttagcatatgcatactctatatgagtcaagagctgaccttttcaaaaaaaaattatactttgacagctgtatatatatatataaagcaacataagacattttaaataacaatatataaatttctatcctgttgtttttaaaactagaaacagggcaattaaataatcattcaatatatgggcaaaaggattccaccttatctttccctcctgccagtggtgcagaaagtggtcaagggagagtggtggatgaagagggataggggagacacagcccttgggaggggtcctctgtctacctggacttgatcaagctgcagtatgactcatcccggcatcggtgacattgcactggggattcctgaaatctcatacagttttccatgaatgattttggtttccatccagcagttcttatcattgatatgaaacaaaaaaaaaaaaagaaagaaaaatagtatttttcagagggcattggtgtgaaaaggcaggtgatgtcagagaacattggactgagtgtcaagaggtttccatttcgagtctggctaaccagccatgtgacattgggtaaatcacagtacttttgtttttgcatatgtcaaatgaaaagcttgaattcatagtcattaatattctttctggtgctaaaatttttgcaacaaaaatagaatagacccaaattcctttcggtggaattaagagtgatcactgattgctgacttttttttttttcttaataagaatagcataggccagacatggtggctcatgcctgtaatcccaacgctttggggggccaaggcaggagaccaacatgggcaattcctgtctctacaaaaaaaaaaaaatttaattagctgaaatgtggcacgtgtcataactacttggaggtgggggctaaggtgggaggactgcttgagcccaggaattggagatgccgtgagctatgattgcaccactgcactctagcctgggtgacaaagaccttgtctcagaaacaaaacaaaatacccccacaaaataactaccttgaagttaattctttattggaacaagtagcacagcattggatagaaaagtacaaaatgcaattttctgcctctgtatgctgttcagtttatggttgttcccgacatcttaggtcactttccagttcaaagttagttttaagtctgagagcaaagatttccttgcctaagggaggattagatgaaacaaggctcccaaaaggcgattggccccctgacaaagctggaacagtggtgagacagatggaagtagaagagaaggaatcagaggcccttttgaatttagaagtggacttgtgagtgctaggatttccctgggtttttcaagcccagagaagaaattggagcaaatttcacaaggcatgggtttttcacctatttgaggaggtgagggatctgttgagaaaagaagaaagctaaggtccctctccttggaaacctgtgcgcacacacacgaagtgtatgaagtacctgtgcgcatacacaccaagtacctgaagtctgtaacttcaggatcttttaagacccatggcatgaagagattggctgaatttgaacaaaggaaccctggggcattagatgtagaactttgttgtctttggagagagacctggtctcacacttaaatacccaggtggccccattttgttttattaaaccaatttcgtctctttgacccccagctcttacaatcacatgcccgattgcacagctttctcccttccagcaaatcctttttgatcactattacataaactctaaattgagtgtccaaattgcaggcgtctaggatccaaaacaaatgtaggttgcaaataagtaaggtttttaaaaaagatctttgtcttcttaagttgctgatagttactgcttgctgggaactgtaggcctttcctggcaagatttctcaacattctcttgagagcagttgtgttaacaagttatgaagattactttaatgctttgcttggaattcatttcgtatctgcataaatcttcaaggccattatcatatcagtgagatatttctagtatttttgagaactctgatgcatcaaaatgtctgagttcagctcgttcttaatgtggtgacagggtcaaatgtgttggtttagattcaggtgtttcgtttttgtttttatcttatgcctccaaacacttaaaagtaaattgggtcgcttatcttcaaatttgaggcaggaaatactgtttggttctcatactttcttcccgtatgtttcatttctgaaacattctggcttgtttacacattgatggtaaccgagcttcccccctccccctcccaactgtaattttgaaaaatttcaaatctgcaggaaagtagaacaatatagactccttcgcttaaattttgtagactcctcacttacatttgccagctcacatttttttacatctggtttctctcgctgtgtgaatgtgtgtgatcttatttttgttgtggttgttgttaaaccactgggaagttgcaggcctgacatttattccctaggtatttcagtatgtatttaccaaaaatcattaaataactattaaattatttaaattaattgtaataccttcatcacactcaaggaatttagcatcaattcactaatatgtgatgcagtccatattcaaattttctactttgtcccaagaatgtcctttacttcagccttttgtttgaggatccagtcaaggatcgacagatttcttttagttgccatgtttctttagtcacctttaatctagaaaaatcctcagcctgttagaccatttgggtaagaatacagcccaggtggtgctggcatgtatctggttgtgatcgcatgataattggttgtaccaaaatcagtgttgctaagtttggtcacttagttacagtagcatctgccaggtcttataaaagggaccctattctcatgtaaaagtttgggtgttggcagggggctgaaaatgggtgtcctattctgagacaaggagaatgaattttcccccaacagccttggcctctctgattgtaacatccactgatgttcttctcagctgtactttgatttgttgttggagatggcatgggggaaaggaaaagtataaaggaaatgtattccagcagatctttgtagaatcaattccattgctcctttatttgtatagttacaagaaatgaatgatgtgagtgctctgtattttctagattgtcatactcaatctatatgaacaaaagaagcttagtttacttctgtctctccatagagaaacctccaaggcaaatatttgtctggagttagtagcctgcaatgattaccgaaggtccagatgaggttattaaaatgcctggtgtttgccctggtggcacacacaagataaatgaggcagaattctttcagcttggttacatgttggtttttcatgttccagttaatagtacagagtaggaacatctgctttagcaggtccagctagataaacagcttctgcagtataacagaaatcagcagcctatgccattgacttaaggagacagatttaaactttgtaaataaaaggtttgactaaagcttatgaggaggaatatttctgcatagatgagaaagctcaagtgaattttgtatttaatctttccccatagggtagtgaactaaaacattagttttgggctagtggctgagaaccatctctttaagacagaaatattttggcaatctaaatctcccttgggcggcattaggtagagagtgatgtaattcctaatctcaaacatttttgtttcaaacatattaaatgtttctacaaagccatcttcgagttgtggctttatggactcaagcggctaaggcagtggttctcagtcagggtgcagtttttttccctagggaacatttggtaatgactggaggcttttttttttttttttcagacggagtctcgctctgtcacccaggctggagtgcagtggcgtgatctctgctcactgcaagctcagcctcccgggttcacgccattctcctgcgactggagacatttttgattgtcacaactaggagggtggtattggcatcaggtacaaaatgtcactgatggcaaggttggaaaaactgctttacaggatagaaagttattttactgacaaatatgtgcagtgtatgagatactgggtgttccaagaaaatgaagtcctggaccctgccttcaaagctggttatatcacagctgttgacaatcacaaaactatggtaaatacactttcttattcatctacgagccttaatgatctgagaggagatggcacagcaggctataagtaggagccccatttgggctgggacttaccagatgagtaggcattagtaagtgtggagggttgagaaatcccactcttcagttcatacagcatcatcattgttccatggaggcctcttattgtttcctcatttgtgcctcctttcctccatgccactggcaaccatattcgtgggttaaatataacagaaatctttaattttgcatgtttttaaaaaataaaatgtgtattgactgtagataacttatgtagatggaattgtgttaagatatctcattcagttcttttccagttaaccctatgctattaaaatcaattcatgttgctatggatccatctattctgttgctttgaattgctttcctggtactccttggagtgtgtagcagttagtatgctttgtgatgaaccatcccaaacttagtgacttaaaacaatggtcactcctttttcgtgagtctgtggggttggttgagtggtttggctgatttgtgtctgggtctgctgatctcagctggtgtcactcattcatctgtgatctgctggagactgcatgatttaagaggtccatggcacattgttgtcatccttcatcagtttggcctaaacttggtcacctgatggcaaggccaggaatccaagggaggagaattgtgcaaggcctatacttggaacttgaccacagtcatttctgccatattctgttggctaaaccaaggcacgagtccaatccacaaatccagtctggattcaaagtgtggggaaatagactccaccacttgatgggaggaactgaaaagcgacattgcaaagggatggttatagggagtttaattagagccattgattagtcagagtatgcatccaccaccttttgcctattcactcttccagtgatggaagccaaagttgattccaactctggaagctgtgataaatatctttgtacatgtcaccttgtggagctgtttgataatttggaagctatattctcaggagtaagattgctgaggcaaatggttacatctacctggaatgtctataggaacagcagaagatgagactggatacttccttgttgagaagttgggatttggtgctaaggtttagtgggcaaccttgagttttaggtaaggttaatgcatttagactcatgttttagagggattatcttggcaatagtgtgagggttggaagagacgggtactacattaggtccttgggtgcctcattggaagctgacttaggccagctgagaatctgaattaaggtcataaaaatggagagaagatgccaggcacagtgtctcacgcctgtaatcccaacactttgggaggccgaggtaggtggatcacgaggacaggagtttgagaccagcctggccaacatggtgaaatcccgtctctactaaaaatacaaaaattagctgggcatggttgtggatgcctgtaatcccagcactttgggaggccgaggtaggtggatcatgaggacaggagtttgagaccagcctggccaacatggtgaaatcccgtctctactaaaaatacaaaaattagctgggcatggttgtggatgcctgtaatcccagctactcgggaggctgaggcaagagaatcacttgaaaccggaaggtagaggttttcagtgagctgagatcgcaccactgcactccagcctgaccgacaagagcgaaactccatcttaaaaaaaaagagaaggtagaatcaacctgacctggtggctgactggatgagggaaaagcaggagtctaggatgacttcctggtttctgtcttgggtaggtggggagatggtgttggcatgagttgctgggaatgagggagaaagaacagatcctcggggagatgataagtaagtcctttttgggcagcattcagtataggagactgtggagtggcaaggcagagatggccagagagcatacttgcatgtgtaggtatgtagcttgaagagaagtcgaggttaaagatgaagatgtgggaatttccagtcaatgggaggaggtgactgctaggggtgggtttgtctaaggcaatggttctcaaactttagctgcatcagaatcacctggaaggttgttaaatcggagctccccaggccccacccccagagttcctgagtcagtagatctggagtggagccatagaatttgcattctaacaagcttccaggtgacgttgatgttgctggtctgggaccacactttgagagccagtctggggcaaaagtacaaatggagaaggccctggcaggccatgttcaaggagtgggcaaagggaaataagtcagcaaaggcatttaagagagtttaggctctgagaagccaagagaatactgagatacccagttaagaccattcctttaagcggctcaattcaaaaggagaagagagcagaaaatagaagacaccacagggtgttgaggatttttccttaccatttaattgttatcataagagacttaagcatcctttcaggatgaaagagtcacacctccttcgcactctaccgactccatgtctctaatttagcacagggaggcggagacattcagactaaatggtcctgctttccacagcatcagaaaacacagaagcagattcatgtccacagtgtgagggatgctagtgatatattgtgaagaaataaaaaatcaagctacagaaaaatatattgagttgtctttatagagaaaaacaattatgtgaagtccccctccatatgtctgcatggttatgcttaaaagaaaacagatttgcaggagagctcttgagcacacagctaagcatttccagcccgcagtttcttctccagaacttagctacttggatgggacagtggagagtgcactagagttggaaagggcactggcatgaggagatcggggctctatcatcgttcatgagttcagcatgacttcacctctctgtgtctcagtttctccatctgtaaaatgggactaattatggtacctacctcagaatcatgatgaggattaaataagaatacatggaaagcccttagaacactgcaagttatgtatgaggtactcaaaatagacataatctgctcttaatgtattttaatatgagttaatagacacaatgacgcttagtgaactttaatatatattatccattagatcctatggtgcaactgtcacatgaaaataaggtggtaacatctctaggaacctaaggttcaaaactcagaatttggggtcacagcagccctaccattagagatgctccttcctatgctggaaagtcatcgtggcagctctgtatcaaccatgaccaaaagggattggcccctgtcttcagacacccatcgtccttgaggttatggcactatgaggttgggagaatcaggaggtttgaaaggtcattggatgtttcttagtgagaactgggtgtcctggggagtgctgagtctgggtcatatgtacgcatgtgtaccaagttgctcatctccagacaagcatccttaacacactcactgctggttcacagaaatgggtggagggtggtggggcagagcattgcctgggcctttctagacttggtgctgtgggaagaccagctgatttgggtttaaacttggaagggctcaagcatggctgagctctcaaccaatttaccaattttttttttttttttttttttttcgagacagagtcttgccctgtcgcccaggctggagtgcagtggtacaatctcagctcactgcaacctccacctcccgggttcaagtgattctcatgtctcagcctcctgagtagctgggattacaggtgtgcaccaccacgcccggctaatttttgtatttttagtagagacagtgttttgccgtcttggccaggctggtctcgatgtcctgacctcaggtgatgcacctgcctcggcttcccaaatgctgtgattgcaggcatgagccaccatacctggccaaccaattttttttcttatgcccccgtgctggactcttgtgtccatgtagtgttccagacttatagaacctaggtgtctcacttttcctcaaagtcggtcatgctttcagtaacttggctattctgattgagcctgtggttcatcagaagtccagaacagatgttcataccctgtgttagccctgtctgtgctcttggggtttatgatttcctaagtcacagtaggggatgggagctttatgcagggaggccctctcgtactgcgggcatcctgaactttcgatgggaatgtctgttcactgcccccaggcatcagatgactgagttcagtcaccctcaaccttgcctggtcagccctgctttctgcaggaccatttgaggttctcacagccagtctttattttcacagctcagtttttagaaaagaggaagcaaattaaggacatctcaaaatgagactaagtgaacacaggagatccatccattctgatttttactgttctcatgtgtagaaaggagtagtggggctgtggatgatttttaaaattgtggttttttttttctgtaaatcgaatttatcaaggctaaagtgtggctttgaaattaggtactcaactgtagggacaaatttgggagatggctctccaaaggaatcccatcagattccagcgtggcagaattctagagcaaagggattttgctggcactgtcaggcttcagcttaaatttacagttcagctgtgtttttgctccaagaaaaaaatatacctgagctgtagatacactgtctggagatgctttagagatctcccatccagtaaataacatcttaatgggaggccttgtccttgccaatgaggggtgccaaaggaagaaatgagttcaagtaaactaggccggacttaaaaatagctgtttactactttctcctagggttattttcctgcagcgcgaggaagaaatcatactgcgaggctcaacacagcaatcgtgtgtgccatttcctcccaggaacctgagaatttctctgccaggattatccttatggtcagctatgggctcatgcttttgagtggtgccaggtgcaactctgaatgtctaaataaactaggaaatactctgacttgttttataggattggtttgcattttcaggttatacaagtataaagaattgtgaattgtagaaagttggaggaaaacatagaaatttggaaatacacaaagttggaaaaaaatgttaaacacctatgctgctataatttttgcttttctttctggacatttttagagcatatgcttaatatttcagtaattaatgatggttatgataaagacaaggtaaacaattggacctgtctttcaacaagtgaatgaataaacagttgtggcatagccaacaatactgcacagcaatgtaaattactaatgtaaacgacctggatgaattttagacattgtgttgaatcagaagccagacacaaaagagtatatacggtatcggggatggtcagcaaaccacagcctacaggccagacccagcccatgacgtgtttttgtgtgacccgcaagctaagaatgacttttatattttttaacggttgcggaaaaaattaaaacaagaatactgttttgcagtttgtaaaaaattatatgcaattcaaatttcagtgtctacaaatagttttattggaacacagccattcacttgtgaactgtctatagctgcctttgtgctccaaggacagagttgaatcattgtgacagagaccgtatggctgcaaagcttaaaatatttgccatctggcaggacttcgctccttctggaggctctaggagagaattggttcccttgtctctccagctgccttcctgggctcatggctccgttccactctcccgactcgtttttcacctttgtggacccttgtgactatatcaggctcatctcgtaatccaggagaacttcctcactttaagattcttaatcccatgtgcaatgtcctctttgccatgtgaaactcctgtttcctctctagtattcatagtcagcccacttctgtggccacatgtgtagttctttttccccccacaccaaccgattctccaccagctggatgtcctataaatcaattcaattctgacactaactggagttagcacagatcccacaggttgaagtctcagtcccaccagactgcccctgcccacttcaaacgccaattgcaagtagtaggtcctgttgacctaaaggaagaaactgaggcaaattaacacaggtagagaattgctttgggataagttgatgactgcagcccgggaagcactgggaagtcctctggagaacaaaagagaggcttcagcttttaaagaaaaaaggatgactcagaggaggggcgattataaaaattgttttcaagaattctccttggtttacggaagtaacattgatgagagattggctatactttgttgaactacagggtatgggttatggtatccagtgtatggcattgttacgttaatttatagctatttgtggcgtcagtctagagccctcatagcaagcaactcggagatgattacttagttcaagggcagaggggtaagatgtgacccctgaaatgaaatgtctcatttcaatgcctccctaggcttgataatttaaagggggcccgcatccctcagataaaaagtttcttttctttctcagtccccaggtaatcccacaatttctgtctgacttagctacaaattggcagttcctgtgacccccacctcaggtacaatcacttgctagaacagctcacagaactcaggaaacacatttactgtaaaggatattacaaaggatacagatgaacagccagaagctgaggtacccagggcaaggcatgtgggcaggggtgtggagcaggagctgtgtccccatggagttgggggtcaccaccctcctggcatgtgaacatgttcttcctcaccaaccttgaagctctgcaaactctgtcctttgaggttcttatggaggctgcatgacagaagcacgctagattaaatcactggccattggtgatcaattcaatcttcagtccctcttccctacccagaggttgggatgtcgggctgaaggttctaaccctctaatcacatgatttgtgccccctagcaaccgcccccgatcctgtggtggttatctagtagctttccagaaatcaccttattaacataaactcagatgtggttgaaaggggcttgttattaaataacaagactttttttcacctttattggtccagggctgttccaggaaccaaggacaaaagaccaaatcttataataaaagatattcctattgctctaatcacttaggaaattataagggttttaggagctataaggcaagaactgtggatgaagaccaaaatgtatatcttattatatcacagtatcacaccatgtaaggtaacatattcatgggttctgaggatcagggcatgaacatctcttggaggccattattctgcctagcactgatggagacaggaggcagccaactcctgcccctggtgaaaccccaccttaagcctaaaacagcctgaaaactgaaaaaccagactgctggtcccgaatgaagcccgctctttcccgacggattctttctgagtaatgtccacctgagcactgggagaacagggtggggccttggaaatttcatgctatttgcagcaggggggagcctagcatttcgtattcctgtgtagtgagctgggattcagtcagtgaggtggagagcctgttagcaggctcccacctcagcctcctgtgtagctggaactacaggctcatgccactatgcccggctaattttttggtatttttaatagagaaggggttatgccatgttgcccaggctggtctcaaactcctgagctcaagcaaggtgcccaccttggcctcccaaagtgctgagattacaggtttgagccaccaggcctggcccagcatccaaatctcttggagaaattgttaaaaatgcagacatctgggacccatcccagaactactgggtcagaatctctgggggtttagtgctctggaatccgtgtttagcaagttacaggtaactgatacactttgcaaagcactgctttaaaagaccaggtgaagagggaagagtgggaggaagaatgactcattgtgctgttatagaaaaaaaccatgttcttgtcacacgaccaggaaagattaggctcgtggacacatagaagggtgaggagtggaatttactgggtgaaaatttactgcttgagcctgggaggttgaggctacagtgagccatgatcgtaccactgcactcaagcctgggtgacagagcgagaccctgtctcagaaaaaaagatctggatgccagtactctctaagcatcataaaggaagatgactcagtctcagagaagctgccgaggctagttcctggagagggttctacaggatctatttctcattttggaggctagtacagctgcagtagcagctacaccctacaaaagtaaagcatcattactttgttctccatcaaccattgggccctctggagaaaggggagcagtgtgagttaagaaaagggcaaccttgttattctgtggttattatgacatgagagcaatgttgggtgtatcagggctgcaggggctggttggggtaccagaggatttgctgaggagtgctggaagctcctgaccagtggctgctctgcagaaattgagggagggttgatgcaagttcctagttcaagagcagccagcccttcagacaccaggggtgtgaaggcaggtcctactggggagagggtgggtaggcagagtaagccagaaaattttttttttttttttaaagacagagtctcactctgttgcccaggctaaagtgcagtggcaccatcccagctcactgtgacctccacttcccggattcaatcaattctcatgcctcagcctcccaagtagctaggattacaggcgcatgccaccacacccagctgatttttgtgtttttggtaagacagggttttactgtgtgggccaggctggtctcaaactcctgggcaagggatccacttgtcttggcctcccaaagtgcttggactgcaggcatgagcctccacgccagggctagaaatgttaatatgcctttctttctttccattattggtaaggaaggaaaattttctagggtaggctcagggttgggtggcggggggggtccaactgaggccttgttgatggagatattgatagccttgtacacagatctttattttttttttgcgttctagtgaacataggtgaaaacttaataagtggcaaaaaaattcccatcacagttgtccctgtttccctgttcatacttcctgacttttgagtgccccagtgagcctttggtcattggttcagtggtgaactaagtgctgtggggaaacaaaggtaactaagccacagcctctgttttcttcttcttcttcttctttttttttttttctttttgagatggagtttcactctgtcactcaggctggagtgcagtggcacgatctcagctcaccgcaacctctgcctcccaggttcaagtgattctcctgcctcagcctcccgagtagctgggattacaggcgcatgccaccacacccagctaatttttgtatttttattagaggcgaggttttaccatgttggccaggctggtctcgaactcctcacctcaagtgatccacccacctcggcctcccaaagtgctgggattacaggtgtgagctaccacgcccagccctgttttcaaagactttgcagttcaaggaagagatgcggacactgaaccacaaaacggggcaggatgaaccagttgctagaatagaggcatcactggccaggtgctcagcgaaggcacccacagtgggatccctggaatgttaaagcaaaagagattccatggctgagcaaggttggaaggccaggttaatcacagttaatgttgtactatgtgactccatgctttaatatgacacattgccaagagatggcttgagtccagcttttcccagatttgaccatgaacctttgcttcataaaatatttctgagaacatgctttgaaaaaggtgacttatggagcagatggcatattttttggtggcttatgtagtattaaatactaattcctaaactatctggagttgacaacctatattttatttcttttaagaaacccagatgcctctcattccctctctttttaatgaattggatccattttgagaaactcttagtactccttgaaataactagacatcctctggaaagttataaaagaaaattaccaagatctaaaattttacttgatcttttctgtgattccacctttttttttttttttttttttttttttgagatggagtcttgctctgtcgcccaggctggagtacagtggcgcgatctcggctcactgcaagctccgcctcccgggatcacgccaattctcctgcctcagcctcccgagtagctgggactacaggcgcccgccaccaagcccggctaattttttgtatttttagtagagacggggtttcactgtgttagccagaatggtcttgatctcctgacctcgtgatccgcctgcctcagcctcccaaagtgctgggattacaggcgtgagccaccacacccggccaattccacctttttactttctcaagtccattcactagttaagcagatttgatgaagttttggccattgtcttaaaaaaaaagttcccctgagaataattctaactttcccagatccttggtgtttacacattgtgtcctgagccttgacagatgtgcaactttttcagagcagcttagtaaaaagttgacagaaggcatgacaagaatgcagcctttattgttgaaaggtttgtggctaaacgtatagagcctgatggagatgttgaatcaattgttgagctctatgctacctgaatatcaagtgaaagctgcacataaaagatcctgcttgtttggggatttttttttccccctaaaacagcagcaattttcattgaaactccagatttattcaggggaaataatatttgggagtgagatgggaaggtgagttgaatgacttgagttgaaagctaaatttttcagtgaagtttttagaaaccagttattacatggcaggatcaaatccctgactgttcgtaagtccagacttgaaagtcaatttgccaatatggtagatatcttcctatgataggaggttgtttttgcatataatttactcctaaaaatgcaggacaagccagcgtttggaaattgaaccctagacttacatattactctaagagaactgagtattggaagtgtcttgggatctaaatttcaaacgcttcagagagctctgcacagataggcagtcaagggaaagggtgaagtgcatctgaaatctgcttgtcacttgcaagctgtgggacctgggacagggactcatatctgtgctgctttcctcttctgaaatcacagttggtcgtaggattgacctcagggccaggctaggattaagtctgtcaatacatggaaagggctcagagctgcctggaccacagggacttctcagtaaatgttagtttattttttatataaatacttaaaacatagattaaacagtaagtatggacaattgtgattacttttctaaagtaaattcctcacatttaccttggtccatcttacttgaaatgacatttagtaggaaaataaacattaatgttggaagaaagacttactgctaaagggaaggaggtaaatggtcataactttggattttatatttgaattcacacattgttggtgggaaaataaattggcctaaactttatgaaagtcagtttaacaatagccatcacaataatgaatgcaggtaccctttgacctagtacttctgtataaacttaccctaaggtgaacctaaacacatacaaagtgtcgtgtgtaaaggtgatagtatgcagcactgtttgcaataggaggagactggaaacaaccaaaaatgtccaccaatgggaaactagtagacacactgtcatactcaggaataccaactatgtagcagtttaaaaagaaataagggccaggtgtggttggctaatgcctgtaatcccaacactttggaaagcagaggcgcgcagatcatgaggtcaggagttcaagaccagcctggccaacatggtgaaaccccgtctctattaaaaatataaaaaattagccgggcatggttgtaggcacctgtaattccagctacttgggaggctgggtcaggagaatcgcttgaaaccagaagacagaggttgcagtgagcccaggtcacgccactgcactccagcctgggcaacaagaacgaaactctgtctcaaaaaaaaaaaaaaaaaaaaaaagaatgcgttctaagttcttagaaaagatctcccaaatgcaaatgtgttaaatcaggaaagcaacctgtgggatgtcagcggggattaagtataactttggaaagatacacaagaaactaagaacattgtccacctctagagagtaggcaggaaaagccatggcaaggaagaccccaaagggtgattccagggacaaagagatttctccctgtttaacctcttatacttttccattttttaaccaggtcagtgtgttatctatttgaagaattaaaataattagaaggaattcaacccacccttcctcctctcataaagatgtttgcagcaagcagtagccctgttagcagtgctgagaccctgggagcttctttctgtgtttaggtctcaggaatggctggttttatttttatcttattgtgagaaatgtgaaactgcgcacaataaaatcacatctgcccaccacttagctttagtcattattaattttttttttttttttttttgagacagagtctcactctgtcacccagcctggagtgcggtggtgcgatcttggctcactgtaagctccgcctcccaggttcacaccattctcctgcctcagcctcccgagtacctgggactacaggcacccgccaccacgcctggctaatttttttgtatttttaggagagacggggtttcaccatgttagccaggatggtctcgatctcctgacctcgtgatccacccgcctcagcctcccaaagtgctgggattacaggcatgagccaccgcgcccggctagtcattattaatttatggtcagtattgtttcatctatgtccttacctattcttctttcagcaggattttaagtgaaattctagatggcatatcatttcgtccataaatattttcataggtagccctaaacaataggaattttccttaatttttttgaaaatattaaatttatatatatgtgtgtatatacatatatatatatatatatttttttttttttttttttttgagacagagtcccactcttgtcgcccaggctggagtgcaatggcacaatctcagctcactgcaacctctgcctctcgggttcaagggattctcctgtctcagcctcccgagtagctgggcttacaggcacccaccaccatgcctggctaatttttgtatttttagtagagacagggtttcaccatattggccaggctggtctcgaactcctgacctcaggtgatccgcccacctcggcctcccaaagtcctgggattacaggcctgagccaccacatctagccttaaaatataaatttttgagttaagcttaacttctctcctcctcctcctcccctccctctctctccctatgcccccacaaaatcacaatactatcatacttgaaaatctgccgtgctaggttattttttaaaacacgaatcctcagtgcatacttttaaagttttcttcacttctgtcacttcaccttgctttttagatgctctctagagaattacttccagcatttcctacatgttaagtggtccttttcaattgaacagtccagtgactttcatcctgtgaacatgtaattaacaatattatcactggcatcagcagttccgcttttccatcttccactcactttaataggctaataaaggtaaaaggcagcaaaatattcagatatttgtgcaaactggtgctgctgtgaagacaggcatggcagaactgtcaaaacagcccttgaggaaacaacccttggaagtattggtttgtcagctcatgtcaggatgcttaacataaaagtctttgggggttgcagtcagtactgtgcaaaaattgaacttgaaatttgaggcccatgagtattttcttacgtaggtatgctctgctccatgcagcttttaggagaggcagcaccaggaaaaacttgtgttccttccgactagagacctgatgattctatgatctaaaaatctaaattgaccccttgctgggccactccctcagctcctgagcaagcttcccttgtgcatttgaaagcgtatttggtttaagagaaatgaaaacatatgctcacacaaaaactgtacacaagtgtcttttgcagcattatttacaatagccaaaatgtggaaacaatccaaatgcccgtcacctgatgaatctataaacaaaacgtggtataccaaacagtggaatattgttcagtcattaaaaagatcgaagcactgttacatgccacaacgaggaggaaccttgacaactttaagctgtatgaaagaagccagacacaaaaggccacatctcgcatgattccatttatgtgaaatgtccaggataggcaaacccatagagaccatagatgagtggttaccttggcctgagggtggtaggggtgggagagaatggggaacagctgctaatgcagaagagatttccttagggtgataaaaatgctctaaagttgattgtgatgatggctatgaatacactaaaatctattgtgtactttaagtggttgaatttatggtatatgaattatctctcaataaagctgttatgtaacaaataggattcatttacactgatgcctcaagatatgcccagaggtcttcactggcatttatttttatctttttcttggagttggggtgcagtgcagcaccggggtgggggatatgctgggtaatataagggtgcaggaaaactggtgtcctttcatctttaaaactctgtgtaaacttagattctctcctcaaaaatcacccatgaaacggtggtgactttgtttgcccctatgatcttattttgcttccagttcttcatctggagttactttaacagataataaactaactccttccttctctacccactcccctcaaactaaatgtaaagcatctttgtacttcataggcaacagtcgatgactttcctttttctggagttttccagggtcaggaattgctttagtgttcaaaaaacagtattggttatcagctaaagacaggcccttttatttatacgacccatcaagcagacagggtttaaaaataacaccaagtcagcggtgtgctttcctggggtgaagcggcgggggggccagcattgtttcccagagaaacgtgacgctggttaaacaacactggggactaactagatgaggctcgggtcacatgtcagcttgttcacttgaaaagctgctgaatgtagaaaaccatggtgggaagaggggcaggaacgcattcacccgggtgtgcacgtgcgacgggggcttgggtgtgcatgtggacccctggtgcctccgtggagccttgtgaggaggagggagggcaggcctgaccttttcagtgccatgttgtgctgaggatgagtgtgccctcccgagtgggagcccccaccctaggaccccccagactccatttgttgtgaagggaaattgcaaccacaatctgctaaatcaggagttggcaaactacagcctgggaaccagatcatgcctgctgcctgtttttagattttctttttttaaagacagagtcttactcccatcccccaggctggattacagtggtgcaatcatggctcactgcagccctgacttcccgggctcaagcaatcctcccacctcagcctcccaagtggctgggactacaggcgcatgccaccacacctggtaatttttttccattttttgtagagacagagtctcactatgttgcccaggtttgtcttaaaatcctgggttcaagtaatccacccgccttggcctcccaaggtgctgggagttacaggcgtgagccatggcatctggcacctgattttggaagtttttgttcaaacacagccatgcccatttgtttatatgttggccactttcgggcctcaacagcagagatgggttagcgccactgtctgtcctgtgaagcctaaaccgttcattatctggccctgtctaagaggaagtttgctgacttcagtgctaaatgatggaattcccttctcatgggagtccctgaagaggactttattggtggtacttggaatctgagtctactgtgtgtgtgaggaaaaccacaggtcccagagctgtatgcctaggggttcaagaacccaactgagtgtgcagtccaattcagattattctgacatggcacattggctgtgtattcattagatggcttgtttttgtttttttttcctccctggagtagtcaagaaggtaattatttggtcatctttcaaatattctttagtggtgtgtttattaattacaagagcatttggagtcagtgaggagcaggcatgagactaatttacattttgcttctaaaggatgaagttgtatgacaccaagtttaatgtttcccggtgagagtaatctcctcatggactgataacctaagtagcttcctggctggcctgcttctcatgctgccctggtaatggatacctgttgagttatttgttcacagtgtttctaggaattgttagtccttctaacagactaacatgtatggtggcagtgggaagggcatgttcacttactgtgatatcctcccaccccttcccaccccagccatggcatagatggttggtccaaaaatgggtgcctggcccaagatgggccaatagtggcatagtactccctgggaaattagacctgagaccgagttgctgtaagtctgtctctgagtgactggagctctaacatttacaatttggattgcctttttctttcatgtggctgggatacagagtaatccagagacagagaaagcagagggggacatcttgcattccccatgacatcttggaagatcttggttcctgcttctccagagtaggcgttttatggcttgggcggggtgggacctcatgggatgctgtataggctctctccatagaccctggcccaggtgctggtcctgaggcctggcctttcctacaagcaaggaggcagtgaggtcagcctagcagctggaggaccagggatgctgcagccaaggggagatgatattcagatgctttggtggcaagactaggagtgagtccttccaattgcacatctggcagcttttgagctcctgaggccagcctggctgggggcaggaaggatggggacagctggacaactattgagggcctgttcgggtagctttctactagccacgcatccgtctagcttcctgtccccagttcacttccttgagatgccttcatggatttctgggagcaagcagcagcagtgaaacaaccgttttcacattctcccccaactcaccatctctatcttatgtagtttacaaaaacaagcttgttttactccatgtataaaaaaatatttttttcaagttaatgtgggcatggccagattttggctctcatactttttaacttctacctataaggtaaccttgtaacttttacccccaatagtctttccatataaacagttacctgttgttcttggaccagagaccgaatcatcacaagcttccttggagcttatgagattcccagagctttgtagcaaagcccctttcctgctcaggttcacacagaagatgtctgtgaccttgaactgctgaatctcctttggcattttgagcataactctagagatggccaaagatcttataaatgagtaaaacctctggaagtcagaaaagaaggtacagattctgcctctacttgcctgctttgggcaagttgccaaagcgtttctccactttgaaaacgtggataaaatcaacactatcaagttgttgcagagattaatggtgatacttaggacgcccatgctagggactcgaaggatgttagctgtttctctttttctcccctgcaaaatgatgcaggccagggccaaaactgaccagttctgctagttgccaacaactctgtaaaaaattgggtggaagaaggagtaaatgactttgaatctgttaaagtgaatttgggagattgatggtaaactttgatatgccagccctcctgtttctacagctagttgagtcggctgagctttgtttttctgtttgaacccctttgttaatttccatgtctttcacaattatcagacttttaatttcattggtggtttgcaacatgacctattaccccatttatttaagaacaacaaagtagaggtctggttgtgaagtcgtatgcttataacattaaaaaaaaaactttttccagtctggtagctgaatctggtgagttcagaaaatctgcttccatccaaaaatgctttcaagttattcccagagaaaaagggttccctgggcctttccttccaaaagagaatgcagacttgttatcaatattatcaatacctgtctgttaacatttgagaggaaggttttttgtctacagtgcacaagctgctgatttcgtgtaattatctcaggtttattggcttgttttgggtacgtccttcccttacataaaactatgccatgcttctctaagagggtgaaaaggtagcagatggtcctttttttcctcatttagggaattattactgttaaacttgtctaaggacaaagatggcagggccttttggcagcatcttacccaggaaggagctcagtgatgtagaggaggcagaattacctaccaaccccctgcatctggctgggcctgagaatcaaactgacatcagacaggttaacaggagggaagtgtatagatttttacacatatgtgggagcccccataggaaaacaaagacccaaggaaatggcaaagcccaagtgcttatatactaggttggacaaaaagaggcaatcgtggaaaagtaacataaggggagaccaaaggaagagcagagttatgttaagaagttctgtttgcacagaattctcttggcctcagctccccacttctggtgatgagaatgttccctttccttctggtgcagggagggcatctttttatctcctgctttcaggaagaaaagggggcagtcagagcacccctcttgcacctgttgtttttgaagtgtctttagctcaaattaatcctatgccaaagtggcatatttcagggtagcatattctgccatccttcagtgaactatttaaaattttagctcatttggcagcagcacttattccagttttagtgggggcattgatttatgaccatccccggtgggtcattacatgcctatttaaattgtgaaatagaccaaggggtgcttctgtgcaactcagttacaggggggaaagttccaataatagaggtgcattattatttgcatgcttaaaaagcctccacaattgtcagtgcagataaaaggccatgctgagccatgaataatcacttgctcctagagtaggggaggggacctctctttttttaagactcaatggaacagaaacgtcacagtaggcatctaaattaacaactcttgtttctgtaagcctggactttctaagcttttcagccaaactatctcacgcctctgagagtgaacttactctctcaggggtcttaaggcgaggcctgaaactacccaggttaaattttagtttgaagttttgtcttactttttaaatttttgtgagctgtctcctcccctacaatatttctggttgtgattttcaatgaaaaggtatttatttatttctctgtgacagtgcttcttccctacctatctcccacatttttgaataaaactgattccccatagtccagcagatctccaaaattagttgtgcactgcagttttccttctcatcattcattagtcacaaaggaagcccaaaggggtgagcagctaactgaaatgccagtggagctttcgaacccaccaaggggagggatattcctctcccaggagcagtgctgtcagtggcttcaaccaggatgggggcatttattaatgagacttgtgaagcagccagctcaggatgactggcatgaaaccttctctcaggaatgcaggtctgctcccaagagggggcaaaggcagccaggaaaggtgcagaacccagcctggcagggccctccccactataccactcatctgctggccttctaggcaacattgcattgaagcaaatcctgctgactcgtcacactcgatcgcatgactgggtctccccatacagccattggcaaaggagatcttgaagatgtgccaactctgaaacactgatgccagaataggttttcaaaaatgcctctagttctatcactgcctgctcagtgaataaaatctgaactccttaacctgccattctgagcactccagggtggccccaaccaccctctccctctatatctcacattaccatccaaagtgttgctaactctatggccttttaccctgtcctcaaagcagttaggtgccaaatcccagcctcatcccggcctggagtacaactgcttacactgaggtcctgacttttctttctttctttttttttttttttttttttgacagagtctcgctctgtcgcccaggctggagtgcagtggcgtgatcttggctcactgcaacctctgccttccaggttcagatgattctcttgcctcagcctcccaagtagctgggactacaggtgcgtaccatcatgcccactaatttttgtatttttagtagagacggggtttcaccgtgttggccaggctggtctcaaactcctgacctcaagtgatccacctaccttggcctcccaaagtgctaggatttcaggtgtgagccaccaggcacagtcagtctggtctttttgaggcagtgagttctctctgagcacccagagtcatttattggtttccccgataacccaagaatgaatctctcaacatgtcttgatgggattccacttcctggacctttgccactggctgcatttgcagtgctagttttctatttatctccctggccacactgaacattcttcaagggaaggagctatgtcgtctttcttgtatacactggccttgtgcatggcttccttagttgtcctggtgtccagtaaccttagtgaccctcattcagctgctagaagagttaaaaaaaaaaaaaaatggagtttttcacaaaggtgctgtaaacaggtataatccaggaaaactcaagtttacatggaaactaaattagaaaatgattgtccttccaaataggattgtatgcattctcttctgaatagtacttctctgaggcttttaaaataaattttgatttacagcaacttgataacatcttttagaaaaaaatcccttaaaatgttggggctcacctaggtttaaaaatgtggttgttgatgcatttttaaaagatattagaaaggcaatattgatggctgttaaatttaaaaataaaacatattcctacaactcaataattcatcatcctccaaggaggattttatttttaaggaattgccctactttgattgcctgaaggttttgattcttctcctcttggaatgaatttgaatttgagactcccaagcaaaattggatttttctcagttgcaaaataccagattcagcatatagggctttcagagggtaactggagagttccattcccatctgccaaattgtataaactgtgctgcagcctctcctagtatttaatgtaggtagaaatttcattttttatgtggcaggtcaaaaagattgaagtgtagaatatagtgagaggagaaactgcctgcaccctcttcagtattatggcagattggccaccttctccatgcagattcttttcgattatagtaataggtgaacttataatcagtgaatatgagaacccatgaatacatatatacatttgtatgctataagggtatgtgatttttgcaatcaagaaagcaatacttggctgggtgcaatggctcgtgcctgtaatcccaacattttgggaggctgaggcaggaggactgcttgagctcaggggtttgagacaagcttagaaaacatagtagaacctcatctctacaaaaaatttaaaaattagcctcatttctacaaaaaaaatttttaagtgacggcacagtggcccatgcctgtaatcccagcactttgggagcccaaggcacgtggatcacttgaggcagggtttgccaagactagcctggccaacatggtaaaaccccatctctactaaaaatacaaaaaattagccaggtatggtggcacacacctgtaatcccagctactcagaagactgaggcatgagaattcattgaacccaggaggtggagtgagctgagatcacaccactgcactccagcctgggtgatggagtgagaccctgtctccaaaaaaaaaaaaaaaaaaaaaaaaagtaatcccggctacttgggaggcagaggtaggagaatcacttgagctcaggaggtcaaggctcaaggctgcagtgagctctgatcgtgccgctgcagtgagctctgatcgtgccactgcactccagccttggcaacagagcaggaccaaaaaagaaaaaaaaaaaaaaagcaacacttagttggttttttgaaaagattgacagaattgacaaacccttagctcaactatgaaaaaacaaaaataacaactatcagaagtgaaagaaaagacattgctaaaaaaagtcaaagtatcataaaagactactatgaacaattatatgccaacaaattggataatctagaagaacagataaacttctagaaacctacgacctaccaagactgaatcatgaaaaatctgaacagacccataactagtaaaaagatggaatcagtaaccaaaaacttcccaacaaagaaaagcccaaggccagatggcttcactagaaaattctaccaaatgtttaaagaagaattaacaccagtccttgtaaaactcttacaaaaaattgaagagagaatgctttcaaacttattctacaaggccatcattaccttgataccaaaatgagataaagatactgtaagtaaacaaagatactatactacaaaccaatatcaatattgattcaaaaaaaaattttttttttccaatacagagtctagctctgtcacccaggctggagtgcagtggtgcaatcactgcaacctccacttcgcaggtttaagcgattctcttgcctcagcctcctgagtagctgggattacgggtgcccgccaccaagcccggctaatttttgtatttttagtagaggtggagtttcaccatgttgaccagcccggtcttgaactcctgacctcaagtgatccacccacctcagcttcccaaagtgctgggattacaggagtgagccaccatgcctggcctcgttaaaaaattctgaacaaaatactagtaaaccaaattcaacgtagtaaaaggattatatgtgttcaactgggatttatttctgaaatgcaaagatggttcaacatgaagactgatgtaatacaccacattaatggaacgaaagataaaaccacatgatcatctcaattgatgcagaaaaagtacttggcaaaattcaacaccgtttcatgataaaaacactaaacacacttggaatagaaggaaattacctcaacatactaaagaccatatatgataagccaacagctaatatcatattcagtggtataaaaaagctttttgtctaagactaggaatagggcaaggatgtctactctgaccacctctattcaacataagaccagaagtcctatccaggcgagaaagagaaataaaagacatccaaataggaaaagagtgattatctatgttaaccaatgacatgacctagtacgtaggaaacactaaagattctaccaaaaaagctgctcaactaataaattcagcacagttgcaggatacaaattcaacacacaaaaaaatcagttggcatttctctgcactaacaatgagcaatcaaaaaaggaagttaagaaaattctatttacaatagaatcaaaaagaataaaacacttaggtaaaagatgtttacactgaaaactacaaaacactgctgaaagaaattaaaggagacataaatagaaagacattctatgttcatagagtggaaaatgtaatattgttaaaatgttcatattatcaaagatgattcacagattcagtgcaatcccagtcaaaatcccagtggcattttttttttttttttttttgcagaaatagaaaaaaaatcctaaaattcctatggaaccacaaaggaccccagagagccaaaacagtagtaagaaagaagaataaagccacaggccccatgcttcctgattttaaaaggtgatacaagctgggcatagtggcatgctacttgggaggctaaggcaggagacttgagcctaggagttttgggctgtagtgaactataatctcacctatgaataaccactgcactccaggctgggcaacataataaggcccttttaaaaaatatgtatatgtttgttttatatgtatataaaacaaagctacagtaatcaaaatagtatggtactggcataaagatagacatatagaccaatggaacagaatagagagcccagtaatatacgctcatatatgtagtcaaaagatctatggactttcctaatttatgatcaatatatgtcatttatggataatagatcactttccaaatggtctatggaaaaatggacaaacataccaagactacacaatgagaaagaaaggacagtctcttcaacaaatggttgggaaaactggatatccacatgcaaaagaatgaagatgaatccttacctgacaccatgtataaaaattaactaaaataaattatagacctaaatgtaagacctgaaactcaaactcctagaagaaaatgagaaaagcttcatgacattggatttggcagttatttcttgcatatgacaacaaaagcacagatgacaaaagcaacagtagacaaataggactataccaaacttaaaacatctacccagcaaaggaaacaatcattacagaaagggaaaagatacctgcaagccatgaatctgataagaggttaatatccagaatatataaagaactcctacaactcaacaacaacaacaataaaaatcaaatgtaaaaacggggaaaggacttgagtagacatttctcagaaaaagatatgcaaatgccaacaagcatatggtaatatgagcaatattaccagtcattaggaaaatgcaaatcaaaaccataatgagctattacctcacacctgttaggatggccactatcaaataaacagaaaataacaagtattgacaagaatgtggtgaaattgggacctttgtgccttgcacatgggaatgtaaaatgatgaggccgctctggaaaacagtacggggggtcctcaaaaaattaaaaataaaatgtactatatgacccaacaatcccacttctgggtatagatccaaaagaattaaagacaggatctttgaatcttaaattcagctgattaaaaaaaaaacaatgaacaaataaaccatacaaaaaaaaaaaaggatcttgagatatttgcacactcatgttcattgcagcattattcacaataaccaagagttagaagcaacctgaatgcacatcaacagattaatgggtaaacaaaatgtgggatatgcagacaatggagaattattcagcctaaaaaaggaaattctgtcatatgctacacatggataaaccttgaggacatcatgctaagtgaaataagccagtcatagaaagtcaaatactgcatgctttcacttatataaggtatctaaagtaatcaaactcctagaaagtagaatgaaaagtagaatgccaagggataaagagagggtgcaagggggagttcctattcagtgcatctacagtttcacttttacaagatgaaaaagttctagagatcttctgcacagcagtgtgcagtcaacactactgtgtatttaaaaatgattaaggtattaaatgttacgttcttttgaccacacgcgcacacacacacacacacaagtaagtcatgaataaaaaggaaaaaaaagcaacaccttaattgtgaggcaactgtaaaataaatgagaattcaagcaaattttggatggaaaagttgaaatcctacagaagcatagtacaattagaaaagcaaggcattgtccatatggggctgggttagctgcagcccgtcgcagtggacgcagcacaggatgtaaagctggggtgctggttgctagttccacctgctgcagacctgcagtggggacagttacctctgagcatcagtagcctcaggcgtagataaggagggtgacctctgccatgtgagacccagctggaagagagagggggcttcttagctgggatagaatctcaagcaaaatcacagtgggttttgatacctggggagtggcagagaggagtcaggaggtgaggggtggggagcttggagaagggcacagaaggaggcgatgggaaaggagatctggcctgtagggtaaaggcctcatggggaggggctgagaaacaaggttgctgagacatgaatttgggctgattagggaagtgccttctaatgctgtccttagcacgctcagccgcctcaatccttcttgaatctgtataaagcagccagtctctgaaaatagagaccactcgatggggcctctgggggcctcctgtaagaggagagagatgcttagtgagacagccttggtcagtgattctcaaactctgttggacttgggaaaagagttaccttccccacccagttcatggcactgtaccctcattggtcctcaaaaggccccccttgtttggtttgttgccttttatcctcatttcttactgttatcctctccccttctcccatgggctaccgttattaatatgtgtttgatgtatatgctgtttgtatgtattcttataaaacaagaaggtttggaatgtgtgtgtttttaatgtacatagatggtagcagtctagaacagcagttggcaaactgtaaagggccagaatagtaaatattttagactttatggaccatatggactctgttgcaactactccactgtgtcattgtagcacaaaagcagccaacgacatatgcaaatgagtgagcatggctgtgttctaataaaactgtatttatggacactgaaatttgaatgtcatgtaatttttatatgtcacaaaatattcttttgattttttccaactgtttaaaaccccttgtagcttgtggaccatacaaaaacactgtggccagatttggctactgggttgtaattgtgtgattcctcatctagctccttgctgctcagtatgttctgtggaccaacagcacgggcatcaccagaaagcttgttagaaatgcagatcttaggcctcatcccagacctgctgggtcagcacctgcattttaacaagacccctggtgattgtgtatacactgatgtttgggaagcactgggcaatgtttcattttttttatcctttctcatttagcactcttctaaagaccgaaccatttcgctagatctaacccattgcttgtaactgcagcacagtatttccatattcacttttccaccaaaaaaaaaaaaaaaaaaaggaaaagaaaaggtaccgagacattggaaagattactggttgccaagggttagaaatgatgcaggtgaaagatgaataggcagagcacggatggtttcaggtggtgaaaatactgtgtgctggctctgatgatggatacatgtcattatacatttgtctaaacccatagaatgcctaccaccatgagtgaaccctaatgtaaactatgggctttggtcaataataatgtgtcattaattggcttatcaattatataaattataggggagctcagggaggagagaaggggatatgtgggaactctgcatgttccaatcaatttttcttttctttttttttttcttcaagacagagtgtccctctgtcaccgaggctggggtgcagtggtgcaatctcagctcactgcaacctccacctcccaggttctaagcgattctcctgcctaagcctccggagtagctgggattacaggcacgcaccaccatgcccagctaattttgtattttcagtagagatggggtttcaccatcttggccaggctggtctcaaactcctggcctcaggtgatccacccgcctctgcctcccaaagtgctgggactacaggcgtgagccaccacacctggcccaatcaattttctgtaaacctaaaactgctctaaaaaatagtctattgaccgagcgtggtggctcacgcctgtaatcccagcactttgggaggcccaggcaggcagatcacgaggtcaggagatcaagaccatcctggctaacatggtgaaaccccgtctctactaaaaatacaaaaaattagctgggcgtggtggtgggcgcctgtagtcccagacactcgggaggctgaggcaagagaatggtgtgaacccaggaggcagagcttgtagtgagctgagatcgcaccactgcactccagcctgggcgacagagcaagactccatctcaaaaaaaaaaaagtgaaggagcatgtcccagaagctccccaactcggcacaatttgaactttttgaagccaactcgtgttttctcttaaaaatacattcaaatttgtatttgccatattcttttgccttaatgtgacaatcaattttaatttctttatacttaaagttcacctcccctcccacagttaaaaaaaattgtgtaaagtgaaagctgcaggaagatgtgttgttgctaccctgtgacatcccccgctcatgcctgccctccactgcctcagttgaaaactgcaatcctaggccaactcctaccttccagaaggtgaggccaagggtctcctgctctcttgctaccctagccctgggccgtcttggtgagggagggaggaaagggagaagctgctggcacatttgggggctgggtctctcagtgtctacctgagtgcctcggtgcctactgttgtttcctgagtaatagcatacctttgacatactctgcccaagtagggaggcctggccaggggcgagaactctgtcctgccaggctcttccgtcagagatggaaggaaggatctggcttggtctccaggggtaccagtgggtctgccaagctgacaccaggctgtgccctccatcccactcctttcctgggagagctgagagagtatgaagccttcccgtacatgtcatcctctctaccttgagcatatttgtgctcatctcctgatggatgtagacaaagaaggaccactgtggcgtgttggagtcaggcgcactaggtggtgggtggtggaactctatggtaagctgtacatctccggtcggaagcagaccagctggcctggggaaaaggcagcatggaaatgtgtgcaggtagactcacctccacggagggcttgacattcctaaacttgttttcaggggccaggtggtcaactctctccatctctgcagccatgagtttactgaccttggccattggaccctactgatcctggtgcagcttgcagctgtgggggcaaaggctaattaggtagaacagatgtgtcgaaggtcacctgttctcatgtgtttcctggactgatcattatgatttaaggccctcccaaattttcttctgtttgaaagaaggtctgataacccgggaatttcagaattaagaatggacatgacaaaggaatatagattcctaaagggcatgtatgtctgccagggccctttcagtttcataaaagcaaggagacttgcagggcgggagatcagaactctcccttgaagatgaagcgcacagtcttacttcctgcactcagaggcagttaaacatccggagggcaagtggaccgagggaatgacagactccagaaagcagccctgaccaagtgggagaggccctccagggcagcgactctcagcatgagggcatggattctcacacccgccagcactggggcaaatgcttggcgtctttggtggaggcaagcatttcataatcctccttgtttgatttttatttcatttcttttgagattgacattaaagagtagctgtgtgacttttgatacatgcacagttgtacaattgcatctgaacctttttgtgtgatgtccctccctcccccaccttcctccctagtgcctaaaggtagaaggacagaggtggagctatcccaagtaaagccggttctcaggctctgtgcagtcccttcaggggacctgtgataaagtggagtcggcacaaatcaaggcttgtacatgtaagattttatcttgacctcaaactgggctgtggacctgaggcagtgctgggaggctctgtagcagaaaagagtccttagacctggctttcagccagggctccagcagctttgcagaacatggttttgaacatagcctttcactgctgtgagcctcagtttccctctgtaaaataaagataatcatatctccatcatacaactgttgtgtggctaaatgagatgtgagcgatgtaactggtgatgtcctatacaaatactgatggtgctggaggtaagacatttattgtcattcaataaacgtctctctcccacacagaaatggaaggagctgtttttatagggactcttgcctcttcctcactactctctcatcctctttcctgtaagcctttatctcagttctgttccttgggagatagcgttcatttttttcttctcctctttgccttttattcccccatgcttcaccaaaacagaaggaaattgtctgttttctgttgctgtgattgaatacctgagactgggtaatctattaaggaaaccattgtttcttccagttttggaggcaggaagtccaaggccaaggggtcatagctggtgagggcctttttgctggtggggactctgcagagttttgaggcggtgcagggcatcacattgcaaggaggctcacgagagacagccagactgacttttaaaacagactccctcttgtgataacaaacctcctcccgagataactcattaatccatgaatggattaatccatttgtgagagcagagccctcatgatccaatcacctcccaaagatcccacctctcaacactgctgcatttgaggaccaagtttccaacacataaagtttgggggacacattcaaaccacagtggaaaccaacatgtgaaatggaaaagtgttgacagaagtaagtaaatgtgggagccaggttagcatctgaccacagacaacaccagccaggcctgcacggacagaggtggccctggaatatcaccaaatccaatcccctcactctaagagtcttcttttcacacagtttgttcagtgttcttgaagactctaagctgtttggctggggctggctgcagctttacttaatggtgacccaggaccatgatccaagtgtttttctctgattctgggggaagatttgtgttctttgtgagtcctgagaagatcttggattgggtcatcagcatccagtattccttttaaatccctggtgtgtggagcagcccatgagaaagagggaagaaaatagggcttcttaaacttgagctgcttgggaagacaccttgctgggctccttcccagaaatgctgattcagcaggtctgggtgtgacctaaaagtctgcatttctcacatgctcctgggggatactgatcctgctggcctgggaccagacatcattggagaatccaaggctacaaggcagaggttggcaaattacagtccagcagccaagtccagccagaacacagttgctcccattcatttacatattgtttatggctgctttcatgctacagtggcagaactgagtagttgtggcagagatcatgtggcccacaaagccaaaaatatttactatttggcctttttttttttttttttttttaaattgagatggagtctcactctgtcgccaggctggaatgcagtggtgcaatcttggctcactgcaacctccgcctcccaggttcaaataattctcctgccttagcctcctgagtagctaggactacaggtgtgtgccaccacgcccagctaatttttgtatttttagcagagacggggtttcaccatgttggttgggatggtctcgatctcttgaccttgtgatctgcccgcctcggcctcctaaagtgctgggattacaggtgtaagccaccgtgcccggcctggccttttacagtaaaagcatgccaacctctgctcttgaggttcctcagcacccttagcccagtagttctaattacaggcatgggacacctcccattcctttctttcactgactgagtaccctagggccactactgttaagaaaccaactctgctaagcattaaatcatgttctctggaagaaaaaacatgagactgatatcactgcttttacctctatctttgccgatcacaaaacaccttaagaccctgcagcaacctaggtggtgctgtacccatcttgtgaaggtacaaaccaaggctcaggaaaatagttatgtctgtggtcacacagcaaattagtgacaaacccaggtctcccaggctttgcacctaacacactacctattgtatataaggcaaaattggatggtactttgtatattggtcatctaattctgtgtaacaaattacccctaaatgtaatagcctaaagcagcagaagacatttgttatcactcacggtgtctgtacataaggaattcaggatcaacgtggctgagcagttctggctcaggtgttttcctaaggttccatcagatgtctgccagagctgcagtcacttaaagtttaactggggctgaagaatccacttccaaggattcagcttggagaatcagcttcactcacgtggctggcaagttggtgctggctattggtgggaaacttcatttctgttccatgttgacctccctgcaaggctgcttgagtgtcctcacaatatggatgctatctcctttttatgacacagcctcccaagtcacatagcataatttctgccacattctgttcatcaaaagcaagtcagtaagtccagcttaccttcaagaagagcatcaaagaatttgtgggcatatcttaaagccagcccagtaggtcaatttccattccattgcctgctgggaaaatcagggtcctgtggtgttgtcacagtgccggtctttagttgatcgtagaacgtgagactaaagtcctaagcaagaataaggtaattcacaaattactagcaacatctaggcctcaagttttgttctgttctggaatagagtacccaaaggaatcttacacagttggacttcagaaaaggtcagagaggaccggaaggagatgcccatcttcatgctgtgtttgaaaacagaaagacgaccacatggtttgaaatcctcccaggcaatccagacatgcttctgctaagggccagctctccattcccaattaaaaactatctttctagcccagaggccaagtgccttgttggagaaagcagcaaggcctgaagcccttcggttgtgcttgttgatgctccacacagttcccctataaagtattaaacatacttcagtaagaactctgcaggggtaggccgggcgcggtggctcatgcctgtaatcccagcactttgggaggccgaggcgggcggatcatgaggtcaggagatcaagaccatcctggctaacacagagaaaccccatctctactaaaaatacaaaaaattagccaggtgatgtggctggcgcctgtagtcccagctactcgggaggctgaggcaggagaatggcgtgaacccgggaggcagagcttgcagtcagccaagatcgcaccactgcactccagcctgggcgacagagtgagactccatctcaaaaaataaataaataaataaaaagaactttgcaggggtagaaggaggaggctgtgaatttgtggattaaatttgcccttccaagtctttgtattaattcatccttatctcagccagctgattgcatttcttgtcagatctgtttccaggcaacgtctggtactaatgggtgagagtccagtttattcttccatgccctgccacctctgtgcaaggcgttgtaagtgtaggaactcatccagacagtaaactctgatctctcgccattcaacagggtccggttgtatcaccttagtcttcataagcagtgtttggataccctctagtggataagtgaagatggtcgccatgcttgctaaacagaagggctccgaacctgggatgagagtggaggtgactggcttgaagagcccctgtgactctggaaagcaaatgtagggagaggtcagcttgaggataatgtaactccttgatgctccaggaaagaggtatactcttccgttgtataatcttctctggcttgatatatttaataacctgatttggaaaacaggtaacaaaaacatcagtacacatatatgtgcatgtgtgtatatttcctagtgcagagagtgtgtgtggttgtaaacaggaattggcaaactttttctataaagggccagatagtaaatatttcaggctatgtagccaggaggccacatattctgttgtagtgtgaaaacagccatagataatacattcatgaataagcatggctgtgttcattgactatacaaaacagacagtgagccgcatgtggccctgggccaaagtttgccaacccctggtgaaaaagaaagaactgaattgtgtttgtctcttgcactagatggcgaattcctcctgtgcagggacccaagcctcattcacctttgtaccctgggcactcagtattgtgcctaccatgtggcaggtgcccatagcctatttactgactcaatatggctcctgtgtcaaactctgtaatatatcacctttcttgcaagatttcttggaattcattgaattaagagcagcatgctctctaacttagatgtttaagccatcagagcaaataggattagttgccatcctgttttccatgtacttgtccttcaccaagatgccatgtgaaagaccagcacttcaaaaggccttgtcgtgatcagccctgttcagcctgaagatggcactacctagtggcccaacagtggtgggcagctgccgggcatcttgttttgcagacgtgacagtggatttgcatagaggcttctgttgcctttactagaatctccatatgcccagaaccttgcacgtgagaagggactggctggtggcattccaggtaatgtcctatccctaagaacacggcaggagccagcttctctgtctcaaacaccagcctattcctctaaggcaggcttatggtctgccaaactgctcttttttttaaggtattaatcacaatagcaactatcctttgtagagtatattgtcttatgtggattttagaaaatatgtattatctctatttattgatgaagaaactgaggcacagaagagttaaattacttacggcatgatgttgatgtgtagtacagtttaaaaacttgaggccaggtgtggtggctcacacctgtaatcccagcactttgggaggccgaggcaggtggatcacctgaggtcaggagttcaagaccagcctggccaacatggcgaaaccccctctctaataaaaatttaaaaatcagccaggtgtggtgtcatgtgcttttgatcccagctactctggaggctgaagcagaagaatcacttgaacccaggggtcggaggttgcagtgagccaaggttgccgctgcactctagcctgggcgacagagcaagactctgtctcaaaaaaaataaataaacttggactaagttttttaactcactgtgccttggttttcctatctataaaatcatcatgataaaacctattttaaggctgggcatggtggctcacgcctgtaatcccagcactttgggaggctgaggtgggcggatcacctgaggtcaggagtttgagaccagcctggccaacatggggaaaccccgtctctactaaaaacataaaaattagctgggcgtggtggcatgcgcttgtaatcccagctactcaggaggctgaggcaggagaatcgcttgaacccaggaggcggaggttgcagtgagccaagatcgcaccactgcagtccagcgtaggcaacagaatgagactccatctcaaaaaaacccaaaaaacaaaaacctattttagggggctagctgtgtgggtcaaatgaggtaaggtacaagaagtgtttccttattccatagtagatattatactgttaccaggggcttgggtacataggtcctcgataaatattggttgaatagatgaaagcaatttgcctagtcacacaggtggtaagaattcaaagcccagctcttcctaccaggccagatggccttgattataccatttaaccaaacaggaacaggggcatgctaaccatggtattgaggtggaccgtgtggcattcaggtgtccacacagggcagggaagacagagcttcagggttacacattcacagttcacttagcctgacatcgtgttggcattattactcatgagagagctctcaagctcagtccatacatgcagggagctggaagtagacttcttggctccacacaagtgtaaaaagcttcagttacagagaaaagtaggttttttacctgagaaagaggagagctgtttctcctaagagccattgtaaaccctggcaataatattagcatagtagtaataattgacacagcacctcgcaagcactcttgtgcatacattgattaactcattttgtcctcccacaccctaggagggaagcctctgtatccccattttacagttgaggaaactgaagctcaggttagtaacttgcccaagggctaatggaattcaggtagactgactccacagtaaggattttccccactaagcaaactctgcctctcagtctgctattaccatgtgcggtagtgtcacctcagcgagagaggaaggagaaggaaggaacagggaatcaaacaatgaagactatgggataaataaaagtagcaccagattggaagatgccgctgaacgctagttctgctttgacccctgactagctccatgaccctaggctggttgcttctgaatgtgtcctggacttctcttcatttgtaagcatctcttcatctgtgaaatgagttaatcaatccaacactaacattctctggccttcaaaccactatgggataagtcttgcctttaagaaaaggtgccatccttggagactgctgtctgatgccaggcctcctttgcaagtggatttccacctgcaaagtcttcatgtgtcaagtcaagacctgcaaagacccatgtcaccagctggggtgtctgtctcagagatttggcattcctcccaccacccaaattttgcctggctaactctcattcacctatttgtctctcacttcctctgaccttccagacttggttgtgtccttgtgctttgcattcttgtatcaccatagtttcttttcataggatttattacagcttataattaaatgtcaactgggggcagagaccatgtctttttttccccatcgttgcactgccattgagacctcaggtggtttgtttttgtttttgtttttgagacggaatctcaccaatcttgtcacccaggctggagtgcaatggcgtgatctcaagtcactgcaaccccagcttcccaggttcaagtgattctcctgcctcagcctctcaggaagctgggattacaagcatgtgccaccacgcctggctaattttttgtatttttagtagagacagggtttcaccacgttggccaggctggtctcaaactcctgacctcgagtgatctgcccttcgcagcctcccaaagtgctgggattacaggcgtgagccacctcgcctggccaagacctgaggtttttgaatgaatgaatgttgccacatatgtgccatattaaatgtacaccagaagtagaacagcaagatatggcgatattggttagttctcttctggcaggccacataatagcaaatctgcagtcactatttccaatgccacttcattgcaaggaattagtatgataaatgatttaaaatctaatgaggtatttcagaggtatgctgagatctcaccagaacaatgcaaatcccctgagctaagccagctgggaacagctggtgctttacttctaggttagcctagttaattgtcaaaagttacctgttttcaaggctagagtacattttcaataatggtgctcctgccagtcaagactaaagtcaaaaataaatcagccaacttatgtcctatagcaatgtagcatttcctgccccaccaatagtgcctagaaaacctgtgtcacaataatactcagtaggtatttgaataaatgacactttttaacactgccatcaggtaattcctctgagcagcagaattgctgtcacaaagctcatagacaccacagggagtcctcagggacaaacttattgtctttctggatgattttaaaaattgtgccagaatcagtggctcataccagtaatcccagcactttggaaggctgaggcagtaggatcacttgagtctaggagttcgaagtcagcccgggcaacatagtgagaccccggctctacaaaaaatttgaaacctagctgggcatggttgcatgcacctgtagttccagctattttggaggctgaggtgggagaatcgcttgagcccaggaggtcgaggctgcagtgagctgtaattgcacctctggactccagcctgagtgacagatcaagaccctgtctcaaaaacaaaaaacctgacatttgttttcttagtccatagaatactcgaataaagatgatgtgagggtaggagggtacacacaaaggacagaggagggcagttgaaatcagctcactgagagctgcaagtggtgagttgattttcaattaaaaaaatttcttcaggctgggcatggtggctcacgcctgtaatcctgtaataggatttgggaggccgaggtgggcagatcacttgagcctaagagttcaagaccagcctgggcagcatggcaagacctcgtttctacaagttaaaaaattacctgagtgtggtggtgtagtctcacctacttacacttgtagtcccagccactcagaaggctaaggtaggaagatcacctgagcccagggaggttgaggctgcaacgagcagtgatcaagccactgcactccagcctggacgacaaaatgagaccagtctcaaaaaacaacaattttttttttcttcatagaaaaacacacataatctggtaccattccaaatagaagcaagcactttccttctatagcacaaggcagcaattgaaatatttgatgtttgtgatgacgctgggtcatcaaaaggtttagctgtgttagtaatactgtatttaattttgaaaaggaggtacagaaaatatatttaattgagctcattaacttattgttcacaggagaggttggaaaagaaaccttaggtcattaaaaaagtagaaacttttagctccataaaagatatccatcatctatcaaaaaccaacaacacatataaaaatgtaaaacattaaaatgataaaacagaataaaataaggattgccaccatcacttgtgttctggaagacggttctggagatttaagccaatgcaataattcaggaaaaagaaacaggtgatataaatattggaaaggaccaaagctgctgttactgcagatggcttagccagaaaattctagaaatcaggcagacacagtgcctcacacctataatcccagcactttgggaggccaaggtgggcagatcacctgaggtcaggagtttgcaaccagcccaaccaacatggtgaaactccgtctctactaaaaatacaaaattagctgggcgtggtggctcatgcctgtagtcccacaggcttgggaggccgaggcaggagaattgcttgaacccaggaggtggaggttgtagtgaaccaagatcatgccattgcactccagcctgggcaacaagagtgaaactccatctcaaaaaaagaaaagaaaagaaaattctagaaatcagctgacatcagtagggtggtcaaatacctgtagacccaaaaggcttgtgaaaaacagaagttcttactcccataactccccatgtttctcctcagagacagctactccggctttacccgtatctatagttataaataatatgtgagctgtcatcttctgattcaattctacatgttaactagtcacttcttgttaccttctctcttagcttgggctgccataacaaaataccatagactgggtggcttaaacaacaggaatttatttctcataatgctgtagacaaagtccaagattaaggggacagcagggtaggtgtctggtgagggctctctcctttggttgcagacagccaccttcttgctgtgtctttacatggcctcactctggtgcatatcagtggagaaagcatgagaggaagctctcttggtgtccctttttataagggtactaatctcatcatgagaggtttagactgcatctaaaccttattacctaccaaaggccctacgtcctgataccatcacactgggatttaggggttcaacatatggatttgggaagcacacgtttggtctgtggcaccatctacatgattgaagcttcctttctccatgttataattcttttttttttttttttctttttttgagacagggtctcactctgtcatccaagctagaatgcagtggcacaatcacagctcattgcaacctcaacctcctgggctcaagcaaccctcccacctcaggctcctgagtagctgggactataggcatgcaccaccatgcctggcttgcttgcttgcttatttacttaatgtagagacagagtcttcctatgttgcccaggctagtcttgaactcctgggctcaagcaatcctcccgcctcagccatccaaagtgctgggattccaaggtatgagccactgtgctcagcctattcgtttatgatttaagtcaatattctgtgtttattatccttacataaatattatttagagctgagtgttgtagtgaacaatgatttcttttgatttttactaaggttaataatagagtgggtttgttttgttttgttttttggtttttggttttttttgcttaggttttttttttttggcgttagttctctctttatagacactctgtttctagaaacaactcgcctgcagctggctggctggaccagcacacgctgacggggctggactatttacaggcctattgtgggctgtactttggccaccccccggcacagcactcaactgtgacaataaaataagttaggtccagccgggcagggcttggagggggcagggacgggggctttacacacaagtgctggggggcttggggcctcagtactctcaagggccgggctttgtagctaattttgtctcacattttttccaattgcctctcagtgaagtttcccacaaggccaatcacgtcacataatcagagttcccatttttatcttggatgtatttctcctggggccctcccttcactgtcatctgtggaattccttttgcctttctgttgggttgaattccttgttttcttatcttccttattgtcctctttcttgctttcctcccacattgtgatggagaagttccctaacagcttcaatcgataaaaagaaagtaaaatgacatcaggcatggtgatgagagcctttaacgtggtttggctgtctttcgagtcactctgttccagtctggttaccttctatgtctgaggcatctgtcatgcttggatttcccttcatcctggggatgaccttcacctctctctgtagttctcttgttggtttattccatgttgccttttttaaagtttatgctctccttttggtgagtcatgtccttcagtagattcctaagaaagggtgcatggaaggtaaatttttcagatattacatatctgaaaaaaatatattctccacttgcccttcattgataatttttgccaagtaatttctagatcaaaaataattttctttcagtaatttgaaatcattggtcattgtcttctaacattctatttacttttagaaaagattaaaaaccattcttgtttctgcctcttttattaggcaacctgtttgttctctggtggtttaaagaaccttctctttgtacctgatgatctgaaacttcatgatgtaccttgatttgggtctatttcatccactgtgctgggtacttagaggagtccttttatgtagaaattcacatccagaaattctgagttttcttgagttatctgatttgagttttcttgagtagctgatttctttccctccattttcttcactctctcttcctggaactttttttttttttggagacaagatctgactctgatctcagctcactacagccttgacctcctaggctcaagcaatcctcctacctcagcctcccaagtagctaggactacaggcacgtgccatcacacccagctaatttttgtatttttttggtagagatggggttttgccatgttacccaggctggttttgaactcctgggctcaagcagtccatccacctcggcctcccaaagtgctgtgattacagacatgagccacctcttctggcccctggaacctactaatcagatgtttgaccttctgaacccatcctctaacttttttactttatctcacctgtttttttcttttcgttgtttttatcttttctaggttttctcgattttatcatgcagcatttctattgatttttaatttctactattccatttttaatttaaaaaactatttttgttttgaaggactatttttatgtccttcttgcaacctcctgtttctttatcacttttgtaatatcttttctctctaagatactgatgattttggggtgggaaatgttttcttctaccccttcaaagttactttcttccagtttgttttttggtttttgctctctgccctgttatataggctttgctttcttcatagatccaataatcttggttatctgcctatgctttaagagtgcaaagctctctggatgctctgagcatgtggatggggcttatgaaccttgaacttcattgaagattgacctggctgggctgtgtgttggggaatccccaaagtcagtatctttgtcttttttcttatgctaatgaagacctggctgccagtattcttagaaccaagcagagggaaaggttagggattggacagatgaggaagtcttcatactgaatacttagtcatttaaggcctttgtttccactataatgttcagaccttcaactgtgcgcctcaatccagagactgtttcgttttaccttatttacagtgtttctcaatcagaagtaattttgcctcccagagaacaattggcaatatccagagacatttttgattgccattaagagtggggaggtggagcacagctgctggcatcaagtacgtagaggacagggaagctgctatacacatcctacagtgtacagtgcacagggcagcactccagatcaataattttattggccaggccaggcccggtggctcacacctgtaatcccagcactttaggaggccaaggcaggcagatcactggaggtcaggagttcgagaccagcctggccaacatggtgaaaccccatctctactaaaaatacaaaaattagctgggtgtggtggcgcacgcttgtaatcccagctactcaggaggctgaggcaggagaatcacttgaacctgggagacggaggttgcagtgagccaagatcgcagcactgtactctagcctgagtgacagagcaagactttgtctcaaaaaaaaaagaatcttattggcacaaaatgtcaatatgcctgaggttgaggaatcctaatctagagaataaactttcacactaatgacagaagtggggcaatcacccagcagcttgcagtagagcaaagggtaaggacttagcgactttcaaacagcttcccaccaatcctccttattttagccgctcctctcccacccccaacctttgcttcctgtcctagagctacctgagtctttttagactttgcagtgaagttggtttgtttcttgacttacctgttaaccaccttagaactcagctttcttagggtcattaagtcagttatccattgttcatatgtgttctaagcttttttttttttttttgagacagagtgttgctctgtcacccaggctggagtgcaacggcatgatctcagctcactgcaacctccgcctgccaggttcaagcaattcttctgcctcagcctcccgagtagctgggattacaggtgcgtgccaccaggcccagctaattttttttttttttgagacggagtctcgctctgtcacccaggctggagtgcagtggtgtgatcttggctcactacaatctctgcctcccaggttcaagtgattcttctgcctcagcctcccgagtagctgggactagatagaggcacatgccaccatgcccaggtaatttttgtatttttagtagagacggggtttcaccatattggccaggctggtctcgaactcctgacctcgtgatccagccgcctcagcctcccaaagtgttgggaatacaggcgtgagccaccacgtcaagcctaatttttgtatttttagtagaggcggggtttcaccatgttagccaggctggtctcgaactcctgacctcaagtgatccacccgcctcagcctcccaaagtgctggaattacaggtgtgagccaccgcacctggctctgttctaagcttctaaaaatgttactgttgtctcttttcctattcaaaccatcctcttgaaaattttagaagggtttttggagggagcaaaattaggtgttcagtctgatatactttccaataatgctaaaatacatgaaatacatgttgaagctacagtcattggcactgacacagcagatgaacatgggtgaatggaattgaataaagattccggaaactgccacaatatattggaagacactgaagacactgataagtgatattgggtcaattgtctatctgctagaaaaaaataaaatttgcctttctttaccccatatatagaactcaatgctagtggattaaagatgtaagcatatatacaaaactacaaaaatacaggagaatgtttttataatcttctgttgagaatgaccttgctaagaaggtaaaaataaaagagttaaagaaaaccaattatgtcggccaggcatggtggttcacacctataatcccagcactttgggagaccatggcaggaggatcacttgagcccaggagttcgagaccagcctgggcaacatagcgagacctcatctctacaaagaaatgaaaatcaaaaagttagccagatgtggtgtattcctgtaatcccagctactcaggaggctgagatagaaagatctcttgagcccaggaggtagaggctgcagtgactcttgatcacaccactgcactccagcctgggcaacagagtgagaccctgtctcaaaaaaaaaaaatatgtaaaaacttaaaacttccatagacaaaagactctatgactttgaaaaataaaactgggtggggaaaatatttgccacatatatagttggttaccatctctcttatgtaaagatctctacaaatcagaaagtgacttttaaaaatctatcaggccaggcacagtggctggccaggtgcagtggctcacacctgtaatcctagtactttgggaggatgaggcgagcagatcacttgaggtcaggaattcgagaccagcccggcccacatggtgaaaccccgtttatactaaaaatacaaaaaattagccaagcatggtggtgcattcctgtaattacagctactcgggaggctgcagcatgagaatcgcttgaacccgggaggcggaggttgcagtgagccaagatcacaccactgcactccagcctgggtgatggagtgagactgtctgaaaaaaaacacacacacacacacactcacaaaaaaaaaaaaaagaaaaaaaactatcaagaaataagaggagaactctaagtggttgataagcattataagcattcaaaaaaatgctctactgtcctcgacactgatgaagaaaaatgcaaattaaagtagaaacaagatgctattcatcagtggttcttcatgtgtagtccctgagccagcagcatcagcatcacctgagaacttgttagaagtgcagattctcaggtccatcctagacctgaatcacaggcaagcggtaggcctagccatttggttcaacaagccctccaggtgattctgatggtcaaatttgagaaatcagaggaaagaaggaactaccttcggtattgcagatgactctcacagtattgagcaacagatgtcagacataagactgaatactacagggtccatttatatgaagatcaaaagcagaaactaatctaggatgatagagatcagggcaattgtcacccttagaggagaggagtaactagaaatggggataaggttttcaggtgctggcagtgttgtgtttcttgatttggatgctggttacacaggtttgttcagttagtgaaacttccccaagctgttcacttaggatttgtgtacttttctttatactgtatttcaatacagcagtgaaagttaaaacataggttctgttttttttttttttaatcaggtttttagccatttaaaacatagaaatttagtctggtgaaggtgcaaaagcatgcatatactgataacagagtaaactaaggttttttgtttgtttgtgtttttgagacagagtctcgctctgcacccaggctctgcgcctgtgctggagtatagtggtgcaatctcagctcactgcaacctccactttcccagttcaagctattctcctgcctcagcctccctagtagctgggattacaggcatgcaccaccatgcccagctaatttttgtattcttagtggagatggggttttaccatgttagccaggcttgtctcaagctcctggcctcaagtgatccgcctgcctcagccgcccaaaatgctgggattataggcgtgagcagctgtgcctggtcagtaaattagtacaagcttttgctgaacaatttggtagtacctctaaagcttaaaatgtgtattctagaaattttcctcctagaagtctgtcctggaattcaggtatacaaaggcataggttataaaaatgtttctgagcatttttgtacaaacataaagaagacaacctaaatttctatcaataggggattggttacatgaattatggaagactgagcaactgttaaaattggcagagatgcatgtgtagtagtgtggaaggttgtcctccatggtattactgactgaaagaagcaagttatagactctgtgaacagagtgatccatatttataaggaagaaagagaaagatgtgcaggcggtggttataaatgcaaggaaagaggccagaaagggtaaatacaaaattgtttatgttggtttttcttgcatttttataactggcggatagggaagggcgttgtcatttcttaatatacttctgtgttaattttttttttttttttttgagacggagtctccctctgtcacccaggttggagtgcagtggcacgatctcggctcactgcagcctctgcctcctgggttcaagcgattctcctgcctcagcctcccgagtagctgggactacaggcaggtaccacgacgcccagctaatttttgtatttttagtagagacggggtttcaccatgttggccaggatggtcttgatctcttgacctcatgatccgcccacctcagcctcccaaagtgctgggatttacaggtgtgagccaccatgcccggctcactgtgttaattttttacctgcatttatcactgaaatgttttataagtcttagttttgccattaaaaaaaaaagtcttagcctaaaaaaaaaatgcttatcagggaaaacaaacagtatttttgtagtctaagcaaatacagattcaggtttatcttaaacacaaagcaaaagatgagtaacatttttgaagactggtttttatcagtagtggttatagtggagacaaaaggtttgcttcttgatatatttcagttacctaggaaattcacttgggtagaacaattcttttcttgacagagacattctttttactttgtttgcttgtgaggtcatgggtcaagtattcccgttctttgaaagacggctcagttaacaatattgtgcctttgtgtaaaagacgaccacagccagcaaactagacaatgcagacctggacagcaggcttcactcgcgttaataatgaaaaacgtttttgcattcagagccaagaactgtgagttgagcctgtttagctggatacagacttgtgatggaaactcttaagcccttgtgatcacacagagagacactatcaacacatctacagtgcctcttcactcactgttatgtttcctatgtgaatcatccacaaagggccgttctgaccctatctcagtcaagaagcctgaaatgtttcagacgctgccatgctgcattacatctattaccagtcttactgatccaacagaatgtcaaatacatgtgtatagattacctgtcagagtcaattcgggccaaaaacctcattagtgtgaggcttagcactttctggaattatatcccattttgtgtatcttcactttcagtaagtgttgttgccacggatgtaaacacaaaagcacatctccattaagcatcttgtctctggaattcatatactaacatcaagcagataaaagaatgttgatgctcaactctaaagagcagaaacagcaacatttagagtcttagctgctccctggcacaggcaccaaaactgtaccaggaaagtggcttctctcgggaagcagtttaacatgtcccttggaaacctgtctgatggcttcaagatcttcacaggaagtcttcttaaagaagggcctgaagtctctcttcaacatctacttcttctaatccctatttgaaggtccccaactacctcagactgagtaggttgaaaattcaactcatgaacaacactcctttagcctgttcctcttccattgttccaacagaacaagtccaaccctgatctactccagaaatctttctagatacctggagatcattccattgtatccgctcccttctcctcccccaaccccatgtctaatccattaaagtaccatctgctgaaatttgtcttgaatttactcacttctcgatattcactgccaccatattggtcttgaagacttcatattcttccacttggattattgcacgctctctaaatttgtctccacaccactgctccccctttcccctccacatgtccattctctacctgcagccagagtggctttataaaaaaatctagcctaatcttaacattctcttgcttaaaactctcccactgcccttcggataaagcacaaaatccctaggcctcctgggctcatatcatctgaccttccccagctctctaacactttgcaccaatatcctaacttactacacattcttacaggttctagaaggtagcagagcccttcccaccttcagacctttgcccacgctgtgtcctctgcctataatgttgccttcctgcttctgtctcgctagtgctttcagccttctggttattcttcagcctggacttctccgatgcttcctgtgcctgccagcaaggtcatttcccccatcatagacccttatcataccgtttaccttcttcataacatttgccacagttgtaatcggtcaggtatttccctccactagactttagtgctctacaagcaggatatgtacaatttgtataccactgtccttggggcctgatagcaggaagcccagatattgtaggtgctcccgtgttaaacaaataaaggaaatctgtcttccgagcctcttgattagagttactttagtattttgattcatataccacaaagaaagctaaaccagaaatgaaattctttgtcctgagtcacacagcgagccaggacttgcagggctagagcccaccctggactcctgttgctgtgtcctgggcatgtggttcacatctcaacttttttgtgacttaggaataaagtccacctggaaggtgctagaatgtgagtgcataccttgctctagccttcctttgtccaggactcaagacacctacagtttaggtcagtttccttttgcttgatgaagtcttcctttagtcaatgagtagtgttactttggctttgggtatggtcttacttgtcagcagttggatgactattgctagggtaaatgcacaacgtgtggtaaaatactgagtgtccacatctggactgggccgctgttcattctctcttctgaaagctgtctcagaccacatgttactggccatctgtgagaagagcagggaatgcccagaggttcgtcccttgaaagcagatcagctccagggaccacctccaagtacacctgcagtctcatttccttgacaaataccagcctgggagcaaattccagccatggatgttgtttctcaccaagtggtgttttaaaacccctgattagtactaatatttaaaatcaagattattatgtacaagcttgagtttctgtgttctcctgggatggagaagacctggcaaaaccagcccacaactatcagctagagctgaattttaagagaaccccctaaaacaagatattgttggtccctgcctggactgccatggttaccttcctggcatttgtaggcacatgagtttgcaaaccctgtaatatttttaagtcatggcaggggaaggtggggtatatgcatgaaagttgtaattgacttagccaggcatggtgctgcacgcctgtaatcctagctacttgggaggctaaggaaggagaatcccttgaacccgggaggtggaggttgcagtgagccaagattgctccatggcactctagcctgggcgacgggagcgagactccatctcaaataaataaataaataagttgtaattgacattctgtataattatttttttttctttgtccctccttccttctttttctttatcttctactgtcccctcctctctccactgcttctaccactttacaggttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtggtaaggaagctgtgggtggtggtcttgtccagtgcccactcggtagatggcattagtcctctactagtcaatccaagactgtctctctgcccagaaaaggtggggccataccatggagaactcaacacagcagataatctcagcatcatctaattgcctttcaagtggcttacacctgggtgtgaaactgggcacattagaaggtccagaaattcctttcaggcagaattgcaaaccaattctcagaagactgaatcaagaaaagccaggttctctccattagattctcattttattatttccctgtgaacaatgtcaactggaaataaatatgccagggcgccaacctctgcagatcgtgcttcctataaacctctcctggggctgtggccttaaccctttgtacatcacagctcttatgatgttggagcacattgtgtatggagttagaatgcaaatgaaaattgctattagaaaacataggtgttcttatatatttgaaaaggagaattgtcaggaatgactggattctcatcctggctctggcaccatgctggatgcaggatggtgaacatgtggtccagggtaaatagataagaaaatgagtagatacgagaccctgtggcatacactgcagtgaagctgtgtagaaagtgtgatggaggctgccacctcagcttaggatggctgggaactcttcagagaggaagtgacatttagcttcatcctggagatcgaacacacacatcctaagtggattcacagagatggaaagtgggttccccttgccttaagagcattgacaatctggttggcaaattcaaagtagctaaatgatttacaaaaaaaatcccagtggtaccacatgtgtttatgtataaaacagagctctccagtgatactatttttttgtctgttttcaaccaatatgtgagaaaaaatatttagttccaaataactgacttatgaaccaaatttgaaatatagtctatttgtggttatagactaagttaagttggcacactttcagacaacactatcattgttcaaaacgcacctggctttgttctttctgtgttgctaagctaagtcccccaggaaaacaagtcttactttatttcacaaggcagattgactgactcttgaccatttccccaaatccaaaagtaaggactctttattaagattttcaagaaagcgttgcaagtttgaaaagtaattccaaataaggtgcttaatcactgtctagggtggtggaaacagccttgttagaattggtgttttgctgcctcagatgggcatcaggagggaaagactcgcttagatgctagattcaaaaaaagttagcaccttgaagtaatagtaactataggaacacaggatgagggaataatcaaagtaggttggaatttaaggaatgccattttggacaaagttgtgtcctagggtgggtcttgaagaaagtgactgtgaacttggaagaagaggaacttggacagtgtagtaggggagcaaattgttgggatggaggaatggacagtacccttatttccccttttgcatgagtctcaatttctagttatgttatctagatcagcaattggcatgctgtctctgtaaaggaccagatagtaagtactgtagtcgtcttgggccacacgcctacggcccagccactcaactctgcctgcagcattgagagaagccataggcaatttgtaaatgaatgagcatggctgtgttccagtaaaactttatttacaaaaactggtggtggccgggcatggtggctcacacctgtaatcttagcattttgggtagacaccagaggtcaggggtttgagaccagcctggccaacatggcgaaatcccgtctctactataaatacaaaaattagcctggcgtagtggcacatgcctgtaatcccagctactcgggaggctgaggcaggagaatcgctcgaacccaggagacggaggttgtaataagctgagatcacgccactgcactccagcttgggcgacagagtgagactctgtctcaaaacaaaacaaaacaaaactagtgatgggccagatttgacccacaggccatagtttacagacctcttgtgttgatcatatgtagtctttctcttctccaagcctaaaactccttcactgatttattacattaaaaattttaaaatattgcctttaattggacttttaaaaagaatattaacaatgccttcttccggcacccctggttttaaaatgctttgatttgcattatcagaatttattatcgtaaggtgtgtccccattttatagataaggaaactgaggtttggagtcttgtgactttgcacagatttacacacagcaggggtccacatctctcgaattccatcagcatttgttttctgatctcatcctgctccaggccccctctgcctgagcggtaggtaggaactacaaccagacaccaggaaaccaggactcctaatccctttagaagggtttaatcatttatcccccttaagcaaggctgtcagcctccaggtcaggggttgcacactcacatatgtgaggcaccagtcaggttgtacaagtgagtaaactcagcatggtattgaaccttgccacccagacacactttcttagcatcttaaacaacttgagaatattcttcacttcacaaataaataagctggaaatgtgctgccaggattgctaaattttctatttgttttctaaggcaatctagaaatctgggctttggtgtgaactctcccaattttaaaatgcttacagccatattcttagaattcgtttgctgctggcagaagctacaggtcaaacatgtctgacttctggttggggtttatgtttactgttacaactaaatacacctttgtaacttctcaaagcatttgtgagttgggtacatggtgttaaccaaatatccagagcggagactggaaaaagtttccgtctgttaacaactaaaggctctgactaaacttccatattttccactgcccagcagaatctcttacagaacagcctgtgggggattcagatgccagcccaactgtcgtgtcccagcacaaatcaggagcatagcaagtgtcaggctgggactttgtgctgaggcagctgacaggctcctgctgccgagttggactgcctaaactcttgctgctcaaagtgtggtccctggaccagcagcatcactgggagattattaggaatacagaatgttaggccctactctaattctgatttgtactgactgaatcagaaattctgtagagggcttcagaatctccattatgacaagatttccagataattcttaggcatctaaaatgtgggaaacactggtttaaaaatagttatagatccataatctctgagtcaaaacctttgggtcagatgtgaattaagagtttgttttgtttcgttttgagatggagtttcactcttgttgcccaggctggagtgcaatggcgcgatctcagctcactgcaacttccacctcccgggttcaagcgattctcctgcctcagcctcccgcgtagctgggattaaaggcatgcgccaccacgcccagctaattttatatttttagtagagacagggtttctccatgttggtcaggctggtctcaaactccccaactcaggtgatccacccgcctcggtctcccaaagtactgggattacaggtgtgagccacggcgcccagcctaagagtttttttttctttcaaattttggaaaggtaataaggtaatttggtgcatttacaacaatatgtgacatgtacccctgagtctggggctgtactgtaatgagacaaattaatgtttctgcaacaacacgtggattttcctgctaagagggataatgaagaccacattgctaccatgtcagctcaggtcagcttttactaccaaatgacttttgaatttagtcttgcttttcagagcatttagggaatctaagattgtagagaagggattggtagacttggttttagtcccctgggaacttgtctgggagaccactgcagaaaccagagttttataatcttgcgtgtagtgccttcattgataaggcatgaactttgcattggaatcttatcttaacaatagctcatccccttaatgtgtctggggaggtagaaagtgacctatatccatttttaatatgcagcagaaaccacagctggttcctactagcacctctgagctcctgggctacaactgttatgataccatttattcagggagacttggataggttttccaacaaatctgatttaagctaaaagttcaaagcaataaaatttgccttcttcatagcaccaagcactagggtctacatgcatgtgtttcctgaggattcgtcctctgtagctcatccctgctgacctcactgcaagccttgtgagctccagagagcagagatgtttgtctccttttaccggttaaagcagctactattttcttttctttttttttttggagatggagtcttactttattgcccaggctggagtatagtggtgcaatctcggctcactacaccctccgcctcccgggttcaaacaattctcctgcttcagcctcctgagtatctgggattacaggcgctcaccaccacgcccagctaatttttgtatttttttagtagagacggggtttcaccgtgttagccaggctggtcttgaactcctgacctcaggtaatctgcccgtcttcgtctcccaaagtgctgggattacaggcgagagccaccgcacctggccggcagttactatttcttaagtacatactatgtgctagatgtcacactgggtcctttatattttacatcatttcatttaatccttacagtaactctgcaaagatagaatgcattatttccattttgcagatgaagaaactggggcactgagaggatgcttgagagccaggaatgggaggcaggtcttctaataccaaccacagttgtgaaccttggagtctgtttggctcccagtatacacagatattccagtttctcttgcccttggaagtagccatttccactgtgccatcctgagcaggaagtgccagcccagatgttgggtcttggcagtcttttcagcatagcagttctaaagagtcccatttgttattgtaaatcttccaaaagacccttcttctaatgatggtgccagaactgagcacatgacttattggcaggggctgagagtcagaaaatgggaccttcctgttgctctgtctccagccagcctgcctgaacctacaggcctaagtccctgctgtcacctggtgggatcatgttataaccaggatccactgagtcttcctgtctcctcttaaccagtcaatccaaatgccttagcctgacgggcacagtcaatttctaaatgactgcctctggcctctagctgatacaatcattaaacaggaataagaaaagtaagttactgtgtatactttatagtttacacaactctttaacaatatggtctcctttgagatgggtgagacttgtatagtttttcccattttgtaaattgagtacaatcagtttgatggtaggtttaatccctataagagaggtccaaaacaacattggtttaaaacttatttctctctcctgtgatagtccagaagtaagtcacctgttctataagatcacctgtgccccaggttcctcctttcttgtgactctgccatctttaacagttggcctgtggtccaaggtggcagcttcagcacctgccatcacatctagattcctagtcagggggagagaaggtaaaaagtgggcagtggagggtacttcttccctttaaggcacagtgttgacattgtatatgttacatctgctcacattctgttagcctaaacgtggtcacctgaccacatctccttccaaaggaggctggaaggtggaatctttaggtggccatgtgctcagctggaaactccgttaccatataataagagagaaacatagcaggagacagccagcagctctgccacagacgaagcagctgaagaggttatttccccaaagccacatagctgtgagcgctgcattggcccatctcctgtatcctgcagcccttcttctagttgcttatcatatcttccttctttcttttttggttgtggattcaaaatacagctttttagatgaaacctacatggagattcccaacagacctgattcagtgtgtctggggtagggcctgggaacatgcttttctgacagatttccagatagtgctgataccactcctgcactttgagtagcactgagctcctttactagctggttgtagacaaggtggggagggaaaaggggattcttagccagcatcagcctgtaccttttcctcagcctttgcccagacccaatctcttctgtcaagcatgagtgtctcttccaccaatgtgtggtaatagggactagagagccagaaaggcaagccgcaggtgaagcggacatccctaccacccttaagaaatggactctgggccaggtgcagtggctcatgccttgtaatcccagcactttaggagttcaaggcaggaggatcacttgagcccaggagttcaagaccagcctgggcaacatagcaagacctgtctctactaaaaataaaaattaggccgggtgcggtggctcacgcctgtaatcccagcactttgggaggctgaggcgggtggatcatgaagtcaggagatcgagaccatcttggctaacccagtgaaaccccatctctactaaaaatacaaaaaattagccaggcgtggtagcatgcgcctgtagtcccagctactcaggaggctgaggcacgagaatcgcttgaacctgagaggcagaggttgcagtgagccaaaatcacgctactgcagtcagcctgggtgacagagtaagattctgtctcaaaagaaaaaaaaagacagaaaagaaatggactctgatggaaaagatgtgtacaaggctgattatactaagcagagggatatttaaataaatgctaagaagagaggcaggtgaagctccaggggagccatccttcccaaatgttcacttaaattttcagcggtttgggtatgccagatggtgaacctaggtagctatgtctttaaactcttgaggactcttgaggatatcagatgcctgaaaatcttgccttcttagctgtctgaatagatgtaacactagggacaggagctgctcattatcccccactatccattttcttctgtagtaatagaagtttcagttgagccttggcccctctgccactgggtgggccctgggactgagttccagctgaggggatgttcgcagcagtgatgtgtgaagcaccatggccctaaagtggggctgcttttttttcttctccccctcctccccttcctagcagctgggattctgctgtggtagtgggacacctcctgggccatgtggagaatggtgagaccctggagatggccaagtattgtggatggagcctgtgtccctgtcaccccgaggctgccagaccagctctggctgcctaagccttagataggagtaaactctctttcctaagccaccgtcttgggtcatgtcaccacagccaaatttactaactgtatattatctcagggcttctttccattatcttgagatctgagatttatcttaatatgtccacaagtactatgcatagctgggtaaaaataagccggtatttgagaaaaaaaaaaagagagaaagagaacatttttataccaaggagggattgactttcagaaaagagtagacttctctctcctcccttcctccaaaaaaagaagttggaaaccttctgtttttgtgtgtgtgtttttggttgttctttgtttgtttttgtttttgagatggagtctcactctgtcacccaggctggagtgcagtggcgtgatctcggctcactgcaacctccctctcccaggttcaagtgattctcaagcctcagcctcctgagtagctgggattacagggcccatcgccacatttgcctaatttttgtatttttagtagagatgggatttcaccatgttggccaggctggtctcgaactcctgacatctcaggtgatctactcgcctcggcctcccagagtgttgggattacaggtgtgagccactgcacccagcggaatttttaaattactatattgtccttgtagctctctttcactgtggcccagggaactggcatttcagttggaggagctataagatttttcaacttgaatagtctctgatccagggcctatttctctatagcaacaagacctcatgtttctatgaaactcagtaacattctagaaccctctgaagcttcacatatccctccttcatttctgtagcccagatttctttttttaacctttatgacgatcctggtttctttgctcttctcttttctttcatctctccacttattttcactacatttcctccaacccaggcattccccggacatgtttacttttgggagtgttaaacaagactagggaagtcacaaagttaggcattgtgagatagtgcctgagagaggcttgtaataaactggcagagcccccagtgtggggggcgcacagagggagaatgcccctgccttctactcacgtctctaccaaccctcttccccttccccatttctttccaagggaaatagcagtttcttgtttctttagagttcagaaaaaatgggccatacttactgagagatgggatcattgcatgttcacaggtcgtagactcagagagtctttctttccccatctcctctctggccccctcgtccacatgggctcgtgcacaaggcccaggacgtcagggcagttctggccaggctgagctttccctgaattctctttcattcattctcattcattctttccttgtataaagaactagacatgcatgagagccctgaaacccatcctcaaagatgttcgttgcagtagcatttgtaatccttgaaaaattagcaacattgaaatgcccatcaataggggaaaagttaaattatgaagtattagtggcaagacaagactaaatggcttggcaagtattaaatttgcgtgactctatattctaagaggtgatatggggaaataataccagtaagagcttttgtgttaatgcacagatgtgtttctagaccaaaaagtaaacaaaagaacacaaccgacattcctaatgagtcatttagtgagaccagggcttcttaggggacagtttcggcagcctgaccctgggtctgactgtgatgaagcccttgtcttaaaggttaagtgccctgacctgaagacagtgtgagcacaggtggaggtggcgacaggaacatacaacctctgccacaaggccagggcctgcagtgggaaaattctatgtagcttttttttctctgagaagaaagagattgcttcctccctttcccctaccccttcctctgtctccaagttactgagggaaagatgttagaccacagagggcccactcctgagaggcatcccccttcctccccagttggtttctgctctggtttcacctcacccctgcctctcccctgtgttcaggcaggacccagctttgcatggtttcctatgcatggttcagagcatggtttcttagagtttagacataactgaaaaccaaatacctaccgggacttacatatcttctctaaaaataggaacaaataaggtaaagccaagggtaacattagttcccaaagggctgtaaccgcctttttaagaacttgcagctaggacagaggagctcatttaaatatccctccctgtttggaatggggggttagggaatcagctgggcctgttttgggggacactgtattgcgcctctacgtcagggacacatgcaagggctacagctgcggctgagggccaggggctgaggctgagcccaccgagtgggcgccactgctgcctgccatcctcagacagcatcagcttggctgacatctggatgagatgaggctcaggagcaaaccgaagaagcaaaatgactgaaggggcggcatgcagtctcagtgtctcgtgggggcaggggttggcatctggtatgagctgccgtaaaaccctctcctctcgcacttagagctgccttcccacagccttctcccccaccctcccacaggtgtccacttgggcccctccccacaccagaggtacagccctcatcacttctgaagtccagaggtatgcagaccctcccctctccctaaacactctgcccctgtgtccccccagggcctgtgctttaacggcagtgccttcgtcttgtacctctctgccgctgttgtagatgcatcttccgtctcccctgagagggacagtcacaacttcaacagctgggcggcctcatcggtgagtagccctccatccccacatgatcctcctcttccctctccaaggcttgcttgggattggggaagacagagtcatctgcaggaaaaagcagcgcttgcagtagtgacaaattagcaattggcttattgatttgaaaatatctaaaactggcagggggcagagggccctcctggcccgaagtgggaaaaggctgggagactgcttgagtgaatgccgaatgactggaacaagataagtattcaagggagaaaagctgtttaaagcatgctaagaataattctactgcctataatttagtaagtgggggaaggttgcagaaaatgaacagaatataattccatttagttttttttaagtgaaaatatttgtttatgcattgagaatgcctagaaaaatatataccagtagaggttccttctagagactgggatcgggaaatgaggggagtgagacaagaaacttctatttttttttttttttttttttagagaaggggtcttgctccatcacccaggctggagtgcagtggcataattatagctcactgcaacctggaactcctcagcttgagccatcctcctacctcagcctcctgaatagctgggactagaatcctgcaccaccatgcccagctaatgttttaacttttttgtagagactaagtctcactatgttgcacaggctggtctggatttcctgggctcaagtgagcttcctgccttggcctcccaaagtgctggaattacaggcatgagccactgcgcctgaccttactttttaatttatatacttctgtttgcatttttaaaccataagtgtgtattatttttctaattaaaaaaaactggtattaagaatctctctgagattggccttaaaatagcccatctccaaaagaagcctatcgggggaaggagggaggcagttagacagaaatgccaaaatgattatgtcaaagctgattgatggtacatgggggttcatcatattctttacttttatttctgtttgaagatctctatttaaaagtagattggtcgggcacagtggcacatgcctgtaatcccagcactctgggaggcctaggtgggtggatcacctgaggtcaggagttcaaggccagcctgaccaacatggtgaaaccccatctctactaaaaatacaaaaaaaaaatgagccgggggtggtggcgggcacctgtaatcccagctacttgggatgctgaggcaggagaattgcttgaacccaggaggcagaggttgcagtgagccaagatcacgccattgcactccagcttgggcaacaagagcgaaactccgtctcgaaaaaacaaaataaaagtagagcatatggatgccggtgacattaaaaatcacaagcttcgtcaagactgggctcaagttaacacgtagcaagaatggactagaactaggtggaggctgccccattaattaagaagggcctgcattttcctcctccctgttcacacctcacataccatgtgggctcattgcttactctggcccactcgactcatttatgtgaactgacactgtagcaatccgagattgtaccccggacctagattgcctgtgctacattagaaatgatacactttcctcagatgcactgccgccgtattcactcctaagtgaactccctgaggttatttgagcaaaactacaggctttcagatgttctccgaaataaaaacagcataaccagaaatcatttgagaaggatagtaattgaaccaataaagtagttttagatggcaaagcctggtatcaagaaaaggtagtgagtgggtgattcaatggaggtgaaatgataacttttgctaattaggatgtgccctaaaccccacttctattatgctttgttttctccagttctttgccttcctggtcaccatctgctacgctggaaatacatatttcagttttatagcatggagatccaggaccatacagtgatttaccattttgataattaaaaggaaaaaaaaaggaagactctcactgtaaaaacagctgtaggtataatgtatattcccagagaattgtatttaactaattaatgttttttatattcttaaatttgctcacaaattgtggtttgttacaattaaactggatacttatttgcaaagtgttgtagcttataatgaactcttaagtatcttattaatgtattaatgtcttcatagatcatattttcttagacaatgtttaaatagataaattgctaatattgagaatgtgtcaagtttgtaaacctaacttttaagatgccagattcttttttgattaaatgttgcaaaatcccaa
